US011913046B2

(12) United States Patent
Hollands et al.

(10) Patent No.: US 11,913,046 B2
(45) Date of Patent: Feb. 27, 2024

(54) INCREASING EXPORT OF 2'FUCOSYLLACTOSE FROM MICROBIAL CELLS THROUGH THE EXPRESSION OF A HETEROLOGOUS NUCLEIC ACID

(71) Applicant: INBIOSE N.V., Zwijnaarde (BE)

(72) Inventors: Kerry Hollands, Newark, DE (US); Lori Anne Maggio-Hall, Wilmington, DE (US); Steven Cary Rothman, Princeton, NJ (US)

(73) Assignee: INBIOSE N.V., Zwijnaarde (BE)

( * ) Notice: Subject to any disclaimer, the term of this patent is extended or adjusted under 35 U.S.C. 154(b) by 0 days.

(21) Appl. No.: 17/049,814

(22) PCT Filed: Apr. 23, 2018

(86) PCT No.: PCT/US2018/028829
§ 371 (c)(1),
(2) Date: Oct. 22, 2020

(87) PCT Pub. No.: WO2019/209241
PCT Pub. Date: Oct. 31, 2019

(65) Prior Publication Data
US 2021/0238574 A1    Aug. 5, 2021

(51) Int. Cl.
C12N 9/88 (2006.01)
C12N 1/20 (2006.01)
C12N 9/04 (2006.01)
C12N 9/10 (2006.01)
C12P 19/18 (2006.01)

(52) U.S. Cl.
CPC ............ *C12N 9/88* (2013.01); *C12N 1/20* (2013.01); *C12N 9/0006* (2013.01); *C12N 9/1051* (2013.01); *C12P 19/18* (2013.01); *C12Y 101/01* (2013.01); *C12Y 204/01069* (2013.01); *C12Y 402/01047* (2013.01)

(58) Field of Classification Search
CPC .......... C12N 9/88; C12N 1/20; C12N 9/0006; C12N 9/1051; C12P 19/18; C12Y 101/01; C12Y 204/01069; C12Y 402/01047; C12Y 101/01271
See application file for complete search history.

(56) References Cited

U.S. PATENT DOCUMENTS

2017/0152538 A1* 6/2017 Lee ................ C12Y 204/01069

FOREIGN PATENT DOCUMENTS

| EP | 2927316 B1 * | 11/2018 | |
| EP | 2927316 B1 * | 11/2018 | ........... C12N 9/1051 |
| WO | 2010/142305 A1 | 12/2010 | |
| WO | 2015/032412 A1 | 3/2015 | |
| WO | 2015/184327 A1 | 12/2015 | |
| WO | 2016/075243 A1 | 5/2016 | |

OTHER PUBLICATIONS

Huertas et al. Paving the way for the production of secretory proteins by yeast cell factories. Microbial Biotechnology (2019), 12: 1095-1096. (Year: 2019).*
Huang et al., "Metabolic engineering of *Escherichia coli* for the production of 2'-fucosyllactose and 3-fucosyllactose through modular pathway enhancement" Metab Eng. 41, pp. 23-38 (May 2017).
International Search Report for International Application No. PCT/US18/28829, dated Feb. 11, 2019, 8 pages.
International Written Opinion for International Application No. PCT/US18/28829, dated Feb. 11, 2019, 13 pages.
Mattila P., et al., "Functional Expression of *Escherichia coli* Enzymes Synthesizing GDP-L-Focose from inherent GDP-D-Mannose In *Saccharomyces cervisiae*", Glycobio, vol. 10, No. 10, Oct. 1, 2000, pp. 1041-1047, XP008023410.
Petschacher Barbara et al: "Biotechnological production of fucosylated human milk oligosaccharides: Prokaryotic fucosyltransferases and their use in biocatalytic cascades or whole cell conversion systems", Journal of Biotechnology, Elsevier, Amsterdam, NL, vol. 235, Apr. 1, 2016 (Apr. 1, 2016), pp. 61-83, XP029733274.
Berninger et al. "Y.lipolytica gene for 3-oxoacyl-CoA thiolase" GenBank: X69988.1 (Jun. 2006).
Chang et al. "Kluyveromyces lactis LAC12 gene for lactose permease" GenBank: X06997.1 (Jul. 2016).
Chin et al. "Metabolic engineering of Corynebacterium glutamicum to produce GDP-L-fucose from glucose and mannose" Bioprocess Biosyst Eng (Feb. 2013) 36:749-756.
Davidow et al. "Y.lipolytica beta-isopropylmalate dehydrogenase (LEU2) gene" GenBank: M37309.1, Curr. Genet. 11 (5) , 377-383 (1987).
Dujon et al. YALIOF10857p [Yarrowia lipolytica CLIB122]—Protein—NCBI Reference Sequence: XP_505264.1 (Jun. 2017).
Dujon et al. "Yarrowia lipolytica CLIB122 YALIOB11858p partial mRNA" NCBI Reference Sequence: XM_500777.1 (Jun. 2017).
Eitzen et al. "Yarrowia lipolytica peroxin Pex16p (PEX16) gene, complete cds" GenBank: U75433.1 (Feb. 1997).
Entian et al. "25 Yeast Genetic Strain and Plasmid Collections" Methods in Microbiology, vol. 36, 0580-9517 (2007).
Fournier et al. "Yarrowia lipolytica centromere and autonomously replicating sequence 18" GenBank: M91600.1 (Jul. 1993).
Karplus et al. "Hidden Markov models for detecting remote protein homologies" Bioinformatics, vol. 14 No. 10, pp. 846-856 (Oct. 1998).
Krogh et al. "Hidden Markov Models in Computational Biology Application to Protein Modeling" J. Mol. Biol, 235, pp. 1501-1531 (1994).

(Continued)

*Primary Examiner* — Iqbal H Chowdhury
(74) *Attorney, Agent, or Firm* — TraskBritt

(57) ABSTRACT

Microbial cells genetically engineered with a heterologous nucleic acid sequence that increases export of 2' fucosyllactose are disclosed. Methods of increasing export of 2' fucosyllactose from a microbial cell and for identifying a heterologous nucleic acid sequence that increases export of 2' fucosyllactose from a microbial cell are also disclosed.

17 Claims, 4 Drawing Sheets

Specification includes a Sequence Listing.

(56) References Cited

OTHER PUBLICATIONS

Marchler-Bauer et al. "CDD: conserved domains and protein three-dimensional structure" Nucleic Acids Research, 2013, vol. 41, Database issue, D348-D352 (Nov. 2012).
Mauersberger et al. "Yarrowia lipolytica ura3 gene for orotidine-5'-phosphate decarBoxylase" J. Bacteriol. 183 (17), 5102-5109 (2001).
Ren et al. "Biochemical characterization of GDP-L-fucose de novo synthesis pathway in fungus Mortierella alpina" Biochemical and Biophysical Research Communications 391 (2010) 1663-1669.
Ren et al. "Mortierella alpina strain ATCC 32222 GDP-D-mannose 4,6-dehydratase (gmd) gene, complete cds" Biochem. Biophys. Res. Commun. 391 (4), 1663-1669 (2010).
Ren et al. "Mortierella alpina strain ATCC 32222 GDP-keto-6-deoxymannnose 3,5-epimerase/4-reductase (gmer) gene, complete cds" Biochem. Biophys. Res. Commun. 391 (4), 1663-1669 (2010).
Saier et al. "The Transporter Classification Database: recent advances" Nucleic Acids Research, 2009, vol. 37, Database issue, D274-D278 (Nov. 2008).
Sanabria-Valentin et al. "Helicobacter pylori strain J166 alpha-(1,2) fucosyltransferase (futC) gene, complete cds" GenBank: EF452502.1 (Feb. 2007).
Sherman "Getting Started with Yeast" Methods in Enzymology, vol. 350, 4, 39 pages (2002).
Titorenko, et al. "Yarrow lipolytica peroxin (PEX20) gene, complete cds" GenBank: AF054613.2 (May 2002).
Zymo Research "Frozen-EZ Yeast Transformation II" Instructional Manual, Revised Apr. 8, 2021.

* cited by examiner

INCREASING EXPORT OF 2'FUCOSYLLACTOSE FROM MICROBIAL CELLS THROUGH THE EXPRESSION OF A HETEROLOGOUS NUCLEIC ACID

CROSS REFERENCE TO RELATED PATENT APPLICATION

This specification claims priority under 35 USC § 371 as a national phase of Intl Patent Appl. PCT/US2018/028829 (filed Apr. 23, 2018; and published Oct. 31, 2019 as Intl Publ. No. WO2019/209241). The entire text of the above-referenced patent application is incorporated by reference into this specification.

INCORPORATION BY REFERENCE OF THE SEQUENCE LISTING

The sequence listing provided in the file named "NB06363USNPseq listing_ST25" with a size of 699,706 bytes which was created on Apr. 19, 2018 and which is filed herewith, is incorporated by reference herein in its entirety.

FIELD

The disclosure relates to microbial cells genetically engineered with a heterologous nucleic acid sequence for increasing export of 2' fucosyllactose, methods of increasing export of 2' fucosyllactose from a microbial cell, and methods of identifying a heterologous nucleic acid sequence that increases export of 2' fucosyllactose from a microbial cell.

BACKGROUND

2' fucosyllactose (2'FL) is a human milk oligosaccharide (HMO) shown to be beneficial to infant health. *E. coli* has been genetically engineered to produce 2'FL by introducing a biosynthetic pathway to GDP-L-fucose, which is then combined with lactose by catalytic action of an □-1,2-fucosyltransferase to generate 2'FL (Lee et al. (2012) Microb. Cell Factories 11, 48-57; Baumgartner et al. (2013) 12, 40-53; US Patent Application 20140024820). U.S. Pat. No. 8,652,808 discloses a bacterial cell engineered to synthesize 2'FL and a sugar efflux transporter to excrete it to growth medium. In addition, others have established a metabolic route to GDP-fucose in *Corynebacterium glutamicum* that could enable production of 2'FL or other fucosylated HMOs (Chin et al (2013) Bioprocess Biosyst. Eng 36, 749-756).

A metabolic route to GDP-fucose has been established in *Saccharomyces cerevisiae* (Matila et al. (2000) Glycobiology 10, 1041-1047)), and the synthesis of 2'FL in *Kluyveromcyes lactis* has been reported as a method to demonstrate successful synthesis of GDP-fucose (US Patent Application 2010/0120701). However, Applicants are unaware of a reported sugar efflux transporter for 2'FL in yeast.

SUMMARY

The present invention provides a genetically engineered microbial cell having the metabolic pathway for the production of 2' fucosyllactose. In one aspect of the invention the metabolic pathway comprises one or more heterologous genes. In another aspect the invention provides one or more heterologous genes that encode a transporter protein that facilitates the export of 2' fucosyllactose from the cell. In another aspect the invention provides a method for the production of 2' fucosyllactose employing the genetically engineered microbial cell of the invention. In another aspect of the invention the genetically engineered microbial cell is a yeast. In another aspect of the invention provides a method for identifying a heterologous nucleic acid sequence that, when expressed in a microbial cell, increases the export of 2' fucosyllactose from the microbial cell.

Accordingly, therefore, the invention provides a genetically engineered microbial cell comprising:
  a) at least one heterologous nucleic acid molecule encoding a transporter protein that facilitates the export of 2' fucosyllactose from the microbial cell;
  b) at least one heterologous nucleic acid molecule encoding a GDP-mannose-4,6-dehydratase (EC 4.2.1.47);
  c) at least one heterologous nucleic acid molecule encoding a GDP-4-keto-6-D-deoxymannose epimerase-reductase (EC 1.1.1.271);
  d) at least one heterologous nucleic acid molecule encoding a 2-L-L-fucosyltransferase (EC 2.4.1.69);
  wherein said microbial cell produces 2' fucosyllactose. In preferred embodiments the microbial cell may be a yeast or bacteria and the transporter protein may be chosen from the family of SetA, Sugar porter or SWEET transporters.

In one embodiment the invention provides a method for the production of 2' fucosyllactose from a microbial cell comprising growing the genetically engineered microbial cell of the invention comprising at least one transporter protein, under suitable conditions and in suitable media wherein 2' fucosyllactose is produced and exported to the media.

In a preferred embodiment the invention provides a method of the production of 2' fucosyllactose from a microbial cell comprising:
  a) providing a genetically engineered microbial cell comprising:
    i) at least one nucleic acid molecule encoding a transporter protein that facilitates the export of 2' fucosyllactose from the microbial cell;
    ii) at least one heterologous nucleic acid molecule encoding a GDP-mannose-4,6-dehydratase (EC 4.2.1.47);
    iii) at least one heterologous nucleic acid molecule encoding a GDP-4-keto-6-D-deoxymannose epimerase-reductase (EC 1.1.1.271); and
    iv) at least one heterologous nucleic acid molecule encoding a 2-□-L-fucosyltransferase (EC 2.4.1.69);
  b) growing the microbial cell of step a) in media comprising a first carbon source, at a suitable temperature, and suitable pH to obtain a suitable cell concentration to produce a seed culture;
  c) seeding the seed culture of step b) into a fermentation media comprising a second carbon source;
  d) growing the seeded culture of step c) at a suitable, temperature and suitable pH until the point of exhaustion of the second carbon source wherein 2' fucosyllactose is produced; and
  e) optionally recovering the 2' fucosyllactose. Optionally the nucleic acid molecule encoding a transporter protein may be heterologous to the cell.

In yet another embodiment the invention provides a method for identifying a heterologous nucleic acid sequence that, when expressed in a microbial cell, increases the export of 2' fucosyllactose from the microbial cell, the method comprising:

a) obtaining a 2'FL-producing yeast cell;

b) expressing a candidate heterologous nucleic acid sequence in the 2'FL-producing yeast cell of (a) whereby a screening cell is produced;

c) growing the screening cell of (b) in a growth medium under conditions where 2'FL is present in the growth medium;

d) determining an amount of 2'FL in the growth medium; and e) identifying the candidate heterologous nucleic acid sequence as a heterologous nucleic acid sequence that increases the export of 2' fucosyllactose if the amount of 2'FL in the growth medium is increased relative to a control cell that does not express the candidate heterologous nucleic acid sequence.

BRIEF DESCRIPTION OF THE DRAWINGS AND SEQUENCE DESCRIPTIONS

Figure 1:
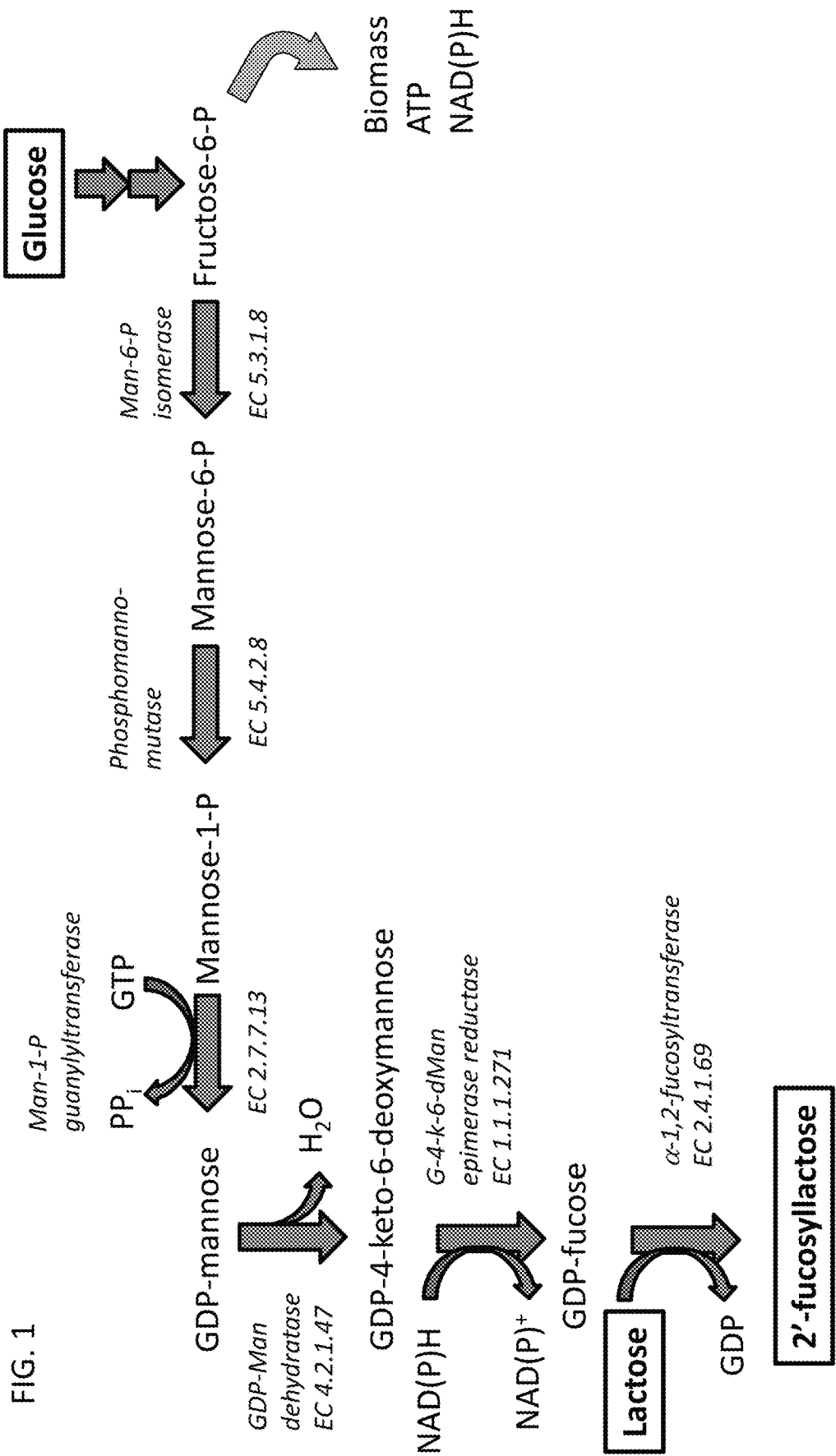
FIG. 1 shows a diagram of a biosynthetic pathway for production of 2'FL.

The disclosure can be more fully understood from the following detailed description and the accompanying sequence descriptions which form a part of this application.

Appendix 1 provides a Profile HMM for the identification of SWEET family transporters. Appendix 1 is submitted electronically herewith and is incorporated herein by reference.

Appendix 2 provides a Profile HMM for the identification of SetA family transporters. Appendix 2 is submitted electronically herewith and is incorporated herein by reference.

Appendix 3 provides a Profile HMM for the identification of Sugar porter family transporters. Appendix 3 is submitted electronically herewith and is incorporated herein by reference.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (2009) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. § 1.822.

SEQ ID NOs:1-17 are the amino acid sequences of *Saccharomyces cerevisiae* annotated monosaccharide transporters Hxt1-17.

SEQ ID NO:18 is the amino acid sequence of *Saccharomyces cerevisiae* Gal2.

SEQ ID NOs:19-22 are the amino acid sequences of *Saccharomyces cerevisiae* transporters Mal11, Mal21, Mal31, and Mal 61.

SEQ ID NO:23 is the amino acid sequence of *Saccharomyces cerevisiae* Mph2.

SEQ ID NOs:24-28 are the amino acid sequences of *Kluyveromyces lactis* transporters Rag1, Hgt1, Kht2, Lac12, and KLLA0B00264p.

TABLE 1

Agt1 homologs in the *Yarrowia lipolytica* genome

| Gene name | Accession # | Encoded protein SEQ ID NO |
|---|---|---|
| YALI0C06424p | gi\|49647383\|emb\|CAG81819.1\| | 29 |
| YALI0C08943p | gi\|49647488\|emb\|CAG81924.1\| | 30 |
| YALI0F19184p | gi\|49651480\|emb\|CAG78419.1\| | 31 |
| YALI0F23903p | gi\|49651677\|emb\|CAG78618.1\| | 32 |
| YALI0B06391p | gi\|49646432\|emb\|CAG82797.1\| | 33 |
| YALI0E23287p | gi\|49650171\|emb\|CAG79901.1\| | 34 |
| YALI0B01342p | gi\|49646248\|emb\|CAG82599.1 | 35 |
| YALI0F06776p | gi\|49650965\|emb\|CAG77902.1\| | 36 |
| YALI0D01111p | gi\|49648139\|emb\|CAG80457.1\| | 37 |
| YALI0F25553p | gi\|49651742\|emb\|CAG78683.1\| | 38 |
| YALI0A08998p | gi\|49168662\|emb\|CAE02704.1\| | 39 |
| YALI0C16522p | gi\|49647774\|emb\|CAG82227.1\| | 40 |
| YALI0C04730p | gi\|49647318\|emb\|CAG81752.1\| | 41 |
| YALI0B17138p | gi\|49646869\|emb\|CAG83256.1\| | 42 |
| YALI0F18084p | gi\|49651432\|emb\|CAG78371.1\| | 43 |
| YALI0D00132p | gi\|49648095\|emb\|CAG80413.1\| | 44 |
| YALI0A14212p | gi\|199424883\|emb\|CAG83980.2\| | 45 |
| YALI0D00363p | gi\|49648106\|emb\|CAG80424.1\| | 46 |
| YALI0A01958p | gi\|49645534\|emb\|CAG83592.1\| | 47 |
| YALI0E20427p | gi\|49650055\|emb\|CAG79781.1\| | 48 |
| YALI0D18876p | gi\|49648874\|emb\|CAG81198.1\| | 49 |
| YALI0B00396p | gi\|49646209\|emb\|CAG82557.1\| | 50 |
| YALI0B21230p | gi\|49647038\|emb\|CAG83425.1\| | 51 |
| YALI0A15125p | gi\|49645951\|emb\|CAG84017.1\| | 52 |
| YALI0A21307p | gi\|49646191\|emb\|CAG84264.1\| | 53 |
| YALI0C16929p | gi\|49647792\|emb\|CAG82245.1\| | 54 |
| YALI0D20108p | gi\|49648926\|emb\|CAG81250.1\| | 55 |
| YALI0D08382p | gi\|49648439\|emb\|CAG80759.1\| | 56 |
| YALI0B19470p | gi\|49646964\|emb\|CAG83351.1\| | 57 |
| YALI0C15488p | gi\|49647738\|emb\|CAG82184.1\| | 58 |
| YALI0E32901p | gi\|49650575\|emb\|CAG80310.1\| | 59 |
| YALI0C21406p | gi\|49647957\|emb\|CAG82410.1\| | 60 |
| YALI0F28017p | gi\|49651843\|emb\|CAG78785.1\| | 61 |
| YALI0D24607p | gi\|49649107\|emb\|CAG81440.1\| | 62 |
| YALI0D22913p | gi\|49649037\|emb\|CAG81369.1\| | 63 |
| YALI0C16951p | gi\|49647793\|emb\|CAG82246.1\| | 64 |

TABLE 2

*Lactobacillus acidophilus* LacS protein and its homologs and MelY and its homologs

| organism | accession | function | SEQ ID NO |
|---|---|---|---|
| *Lactobacillus acidophilus* | gi\|58337730 | Lactose permease | 67 |
| *Streptococcus thermophilus* | sp\|P23936 | Lactose permease | 68 |
| *Streptococcus salivarius* | gi\|490286580 | PTS sugar transporter subunit IIA | 69 |
| *Streptococcus vestibularis* | gi\|489184815 | PTS sugar transporter subunit IIA | 70 |
| *Streptococcus infantarius* | gi\|504100760 | PTS sugar transporter subunit IIA | 71 |
| *Lactobacillus delbrueckii* | gi\|737199160 | PTS sugar transporter subunit IIA | 72 |
| *Lactobacillus hamsteri* | gi\|640655046 | PTS sugar transporter subunit IIA | 73 |
| *Streptococcus equinus* | gi\|654498652 | PTS sugar transporter subunit IIA | 74 |
| *Streptococcus infantarius* | gi\|504101192 | PTS sugar transporter subunit IIA | 75 |
| *Leuconostoc lactis* | gi\|657713137 | PTS sugar transporter subunit IILA | 76 |
| *Leuconostoc pseudomesenteroides* | gi\|491048775 | PTS sugar transporter subunit IIA | 77 |
| *Weissella paramesenteroides* | gi\|488916236 | PTS sugar transporter subunit IIA | 78 |
| *Pediococcus pentosaceus* | gi\|488923422 | sugar (Glycoside-Pentoside-Hexuronide) transporter domain protein | 79 |

TABLE 2-continued

Lactobacillus acidophilus LacS protein and its homologs and MelY and its homologs

| organism | accession | function | SEQ ID NO |
|---|---|---|---|
| Oenococcus kitaharae | gi\|495018441 | PTS sugar transporter subunit IIA | 80 |
| Weissella hellenica | gi\|755142898 | PTS sugar transporter subunit IIA | 81 |
| Dickeya chrysanthemi | sp\|Q9S3J9 | Sugar efflux transporter | 82 |
| Enterobacter cloacae | tr\|P96517 | MelY Lactose permease | 83 |
| Cronobacter turicensis | gi\|495041281 | Lactose permease | 84 |
| Cronobacter dublinensis | gi\|495028954 | Lactose permease | 85 |
| Cronobacter sakazakii | gi\|495174421 | Lactose permease | 86 |
| Klebsiella pneumoniae | gi\|501537408 | galactoside permease | 87 |

TABLE 3

Examples of sugar transporters; AA is amino acid sequence, SEQ ID NO S.c. is the S. c. native or codon optimized coding sequence for S. cerevisiae, SEQ ID NO Y.1. is the codon optimized coding sequence for Y. lipolytica

| organism | protein | AA SEQ ID NO | SEQ ID NO S.c. | SEQ ID NO Y.l. |
|---|---|---|---|---|
| Escherichia coli | SetA | 88 | 166 | 188 |
| Acinetobacter baumanii | AdeB | 89 | 167 | 189 |
| Escherichia coli | AcrD | 90 | 168 | 190 |
| Escherichia coli | LacY | 91 | | |
| Escherichia coli | FucP | 92 | | |
| Arabidopsis thaliana | Sweet1 | 93 | 169 | 191 |
| Arabidopsis thaliana | Sweet4 | 94 | 170 | 192 |
| Arabidopsis thaliana | Sweet10 | 95 | 171 | 193 |
| Arabidopsis thaliana | Sweet11 | 96 | 172 | 194 |
| Batrachochytrium dendrobatidis | 006679806.1 | 97 | 173 | 195 |
| Batrachochytrium dendrobatidis | 006677490.1 | 98 | 174 | 196 |
| Batrachochytrium dendrobatidis | 006677187.1 | 99 | 175 | 197 |
| Rozella allomycis | EPZ32924.1 | 100 | 176 | 198 |
| Albugo Candida | CC147089.1 | 101 | 177 | 199 |
| Albugo Candida | CC147088.1 | 102 | 178 | 200 |
| Albugo Candida | CC143476.1 | 103 | 179 | 201 |
| Albugo Candida | CC110456.1 | 104 | 180 | 202 |
| Bacillus subtilis | YwbF (SetA) | 105 | 181 | 203 |
| Bacillus subtilis | YuxJ (SetA) | 106 | 182 | 204 |
| Mucor circinelloides | SetA | 107 | 183 | 205 |
| Geobacillus stearothermophilus | SetA (MalA) | 108 | 184 | 206 |
| Neurospora crassa | CDT1 | 65 | 185 | 207 |
| Neurospora crassa | CDT2 | 66 | 186 | 208 |
| Saccharomyces cerevisiae | Mal21 | 20 | 187 | 209 |

SEQ ID NOs:109-115 are amino acid sequences of putative HMO ABC transporters from Bifidobacterium longus infantum with numbers 2359, 2360, 0425, 2342, 2343, 2345, and 2346, respectively.

SEQ ID NO:116 is the nucleotide sequence of the coding region for lactose permease from Kluyveromyces lactis.

SEQ ID NOs:117, 118, 120, 121, 123, 124, 126-130, 133-136, 142-145, 150, 151, 153-158, 160, 161, and 216-246 are PCR and/or sequencing primers.

SEQ ID NO:119 is the nucleotide sequence of the PMA1 promoter.

SEQ ID NO:122 is the nucleotide sequence of the TPS1 terminator.

SEQ ID NO:125 is the nucleotide sequence of plasmid pUC19-URA3-YPRCΔ15.

SEQ ID NO:131 is the nucleotide sequence of a Kluyveromyces lactis beta-galactosidase 5' fragment.

SEQ ID NO:132 is the nucleotide sequence of a Kluyveromyces lactis beta-galactosidase 3' fragment.

SEQ ID NO:137 is the nucleotide sequence of plasmid pHR81-ILV5p-R8B2y2.

SEQ ID NO:138 is the nucleotide sequence of the ILV5 promoter.

SEQ ID NO:139 is the nucleotide sequence of the ILV5 terminator.

SEQ ID NO:140 is the nucleotide sequence of the coding region for GDP-mannose dehydratase from E. coli.

SEQ ID NO:141 is the nucleotide sequence of the coding region for GDP-4-keto-6-deoxymannose epimerase reductase from E. coli.

SEQ ID NO:146 is the nucleotide sequence of the PDC promoter.

SEQ ID NO:147 is the nucleotide sequence of the ADH1 terminator.

SEQ ID NO:148 is the nucleotide sequence of the hybrid promoter (PGK1(UAS)-FBA1).

SEQ ID NO:149 is the nucleotide sequence of the TDH3 terminator.

SEQ ID NO:152 is the nucleotide sequence of the coding region for FutC from Helicobacter pylori with BsaI sites on the ends.

SEQ ID NO:159 is the nucleotide sequence of a 2.6 kb trp1□::URA3 integration cassette:

SEQ ID NO:162 is the nucleotide sequence of the FBA (L8) promoter.

SEQ ID NO:163 is the nucleotide sequence of the coding region for beta-galactosidase from Kluyveromyces lactis.

SEQ ID NO:164 is the nucleotide sequence of the coding region for AGT1 from S. cerevisiae.

SEQ ID NO:165 is the nucleotide sequence of plasmid pLMH101.

SEQ ID NO: 210 is the nucleotide sequence of the coding region for GDP-mannose dehydratase (GMD) from Mortierella alpina, codon optimized for expression in Yarrowia.

SEQ ID NO: 211 is the nucleotide sequence of the coding region for GDP-4-keto-6-deoxymannose epimerase reductase (GMER) from Mortierella alpina, codon optimized for expression in Yarrowia.

SEQ ID NO: 212 is the nucleotide sequence of the coding region for lactose permease from Kluyveromyces lactis, codon optimized for Yarrowia.

SEQ ID NO: 213 is the nucleotide sequence of the coding region for FutC from Helicobacter pylori codon optimized for Yarrowia.

SEQ ID NO: 214 is the nucleotide sequence of plasmid pYKH033.

SEQ ID NO: 215 is the nucleotide sequence of plasmid pYKH036.

DETAILED DESCRIPTION

The following definitions may be used for the interpretation of the claims and specification:

As used herein, the terms "comprises," "comprising," "includes," "including," "has." "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Compositions and methods described herein to comprise a given element may also consist or consist essentially of that element. Unless expressly stated to the contrary, or otherwise clearly indicated by the context, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

"Gene" refers to a nucleic acid fragment that expresses a specific protein or functional RNA molecule, which may optionally include regulatory sequences preceding (5' non-coding sequences) and following (3' non-coding sequences) the coding sequence. "Native gene" or "wild type gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature.

The term "endogenous gene" refers to a native gene of an organism. A "foreign" gene refers to a gene not normally found in the host organism, but that is introduced into the host organism by gene transfer. Foreign genes can comprise native genes inserted into a non-native organism, or chimeric genes.

"Promoter" or "Initiation control regions" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters which cause a gene to be expressed in a cell type at most times are commonly referred to as "constitutive promoters".

The term "expression", as used herein, refers to the transcription and stable accumulation of coding (mRNA) or functional RNA derived from a gene. Expression may also refer to translation of mRNA into a polypeptide. "Overexpression" refers to the production of a gene product in transgenic organisms that exceeds levels of production in normal or non-transformed organisms.

The term "transformation" as used herein, refers to the transfer of a nucleic acid fragment into a host organism, resulting in genetically stable inheritance. The transferred nucleic acid may be in the form of a plasmid maintained in the host cell, or some transferred nucleic acid may be integrated into the genome of the host cell. Host organisms containing the transferred nucleic acid fragments are referred to as "transgenic" or "recombinant" or "transformed" organisms or "transformants".

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

The term "selectable marker" means an identifying factor, usually an antibiotic or chemical resistance gene, that is able to be selected for based upon the marker gene's effect, i.e., resistance to an antibiotic, wherein the effect is used to track the inheritance of a nucleic acid of interest and/or to identify a cell or organism that has inherited the nucleic acid of interest.

As used herein the term "codon degeneracy" refers to the nature of the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it may be desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to improve the production of the polypeptide encoded by the DNA without altering the sequence of the polypeptide.

The term "heterologous" means not naturally found in the cellular location of interest. For example, a heterologous gene refers to a gene that is not naturally found in the host organism, but that is introduced into the host organism by gene transfer. For example, a heterologous nucleic acid molecule that is present in a chimeric gene is a nucleic acid molecule that is not naturally found associated with the other segments of the chimeric gene, such as the nucleic acid molecules having the coding region and promoter segments not naturally being associated with each other.

As used herein, an "isolated nucleic acid molecule" is a polymer of RNA or DNA that is single- or double-stranded, optionally containing synthetic, non-natural or altered nucleotide bases. An isolated nucleic acid molecule in the form of a polymer of DNA may be comprised of one or more segments of cDNA, genomic DNA or synthetic DNA.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the number of matching nucleotides or amino acids between polynucleotide or polypeptide sequences, respectively. "Identity" and "similarity" can be readily calculated by known methods, including but not limited to those described in: 1.) *Computational Molecular Biology* (Lesk, A. M., Ed.) Oxford University: NY (1988): 2.) *Biocomputing: Informatics and Genome Projects* (Smith. D. W., Ed.) Academic: NY (1993); 3.) *Computer Analysis of Sequence Data. Part I* (Griffin, A. M., and Griffin, H. G., Eds.) Humania: NJ (1994): 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign program of the LASERGENE bioinformatics computing suite (DNASTAR Inc., Madison, Wis.).

Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989): Higgins, D. G. et al., *Comput. Appl. Biosci.*, 8:189-191 (1992)) and found in the MegAlign v 8.0 program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

Additionally the "Clustal W method of alignment" is available and corresponds to the alignment method labeled Clustal W (described by Higgins and Sharp, *CABIOS.* 5:151-153 (1989); Higgins. D. G. et al., *Comput. Appl. Biosci.* 8:189-191(1992): Thompson, J. D. et al, Nucleic Acid Research, 22 (22): 4673-4680, 1994) and found in the MegAlign v 8.0 program of the LASERGENE bioinformatics computing suite (DNASTAR Inc.). Default parameters for multiple alignment (stated as protein/nucleic acid (GAP PENALTY=10/15. GAP LENGTH PENALTY=0.2/6.66, Delay Divergen Seqs (%)=30/30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polynucleotides or polypeptides having the same or similar function or activity to a polynucleotide or polypeptide disclosed herein. Useful examples of percent identities include, but are not limited to: 50%, 55%, 60%, 65%, 70%, 75%, 80%, 85%, 90%, or 95%, or any integer percentage from 50% to 100% may be useful in identifying polypeptides of interest, such as 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable polynucleotides typically encode a polypeptide having at least 50 amino acids, preferably at least 100 amino acids, and more preferably at least 125 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.): 2) BLASTP, BLASTN, BLASTX (Altschul et al., J. Mol. Biol., 215:403-410 (1990)); 3) DNASTAR (DNASTAR, Inc. Madison, Wis.): 4) Vector NTI® (Life Technologies), 5) Sequencher (Gene Codes Corporation. Ann Arbor, Mich.): and 6) the FASTA program incorporating the Smith-Waterman algorithm (W. R. Pearson, Comput. Methods Genome Res., [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used herein are well known in the art and are described by Sambrook, J. and Russell, D., *Molecular Cloning: A Laboratory Manual*, Third Edition, Cold Spring Harbor Laboratory Press, Cold Spring Harbor, N.Y. (2001): and by Silhavy, T. J., Bennan, M. L. and Enquist, L. W., *Experiments with Gene Fusions*, Cold Spring Harbor Laboratory Press, Cold Spring Harbor, N.Y. (1984): and by Ausubel, F. M. et. al., *Short Protocols in Molecular Biology,* 5$^{th}$ Ed. Current Protocols. John Wiley and Sons, Inc., N.Y., 2002. Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

The term "E-value", as known in the art of bioinformatics, is "Expect-value" which provides the probability that a score calculated for the relatedness between a query and a subject will occur by chance. It provides the statistical significance of the relatedness of a subject to a query. The lower the E-value, the more significant the relationship between the query and the subject.

The Conserved Domain Database (CDD) is a database of well-annotated multiple sequence alignment models for domains and full-length proteins. These are also available as position-specific score matrices (PSSMs) for identification of conserved domains in protein sequences. The CDD includes curated domains, which use 3D-structure information to explicitly define domain boundaries and provide insights into sequence-structure-function relationships, as well as domain models imported from several external source databases (Pfam, SMART, COG, PRK, TIGRFAM). The CDD is further described in Marchler-Bauer et al. (Nucleic Acids Res. 2015 Jan. 28:43(Database issue):D222-2.)

A Profile Hidden Markov Model (HMM) characterizes a set of proteins based on the probability of each amino acid occurring at each position in the alignment of the proteins of the set. The theory behind Profile HMMs is described in Durbin et al. ((1998) Biological sequence analysis: probabilistic models of proteins and nucleic acids (Cambridge University Press)) and Krogh et al. ((1994) J. Mol. Biol. 235:1501-1531).

HMMER is a Profile HMM building and searching toolbox (Eddy. S. R.; Janelia Farm Research Campus, Ashburn, Va.). Hmmbuild is a utility that enables building an HMM from an existing alignment of a few representative sequences. Hmmsearch is a utility that enables searching a database of sequences using an HMM to find homologs that belong to the family the HMM represents.

SAM is a package of Profile HMM tools. The algorithms in SAM are described in Karplus et al. ((1998) Bioinformatics, 14(10):846-856).

In one aspect, the disclosure provides a genetically engineered microbial cell that includes a heterologous nucleic acid sequence that, when expressed in the microbial cell, increases export of 2' fucosyllactose from the cell relative to the level of export of 2' fucosyllactose in a control cell that does not express the heterologous nucleic acid sequence.

In another aspect, the heterologous nucleic acid sequence that increases export of 2'FL is used in a method of increasing export of 2'FL from a microbial cell. The method includes the step of obtaining a microbial cell which produces 2'FL, such as a 2'FL producing E. coli cell or a 2'FL producing yeast cell described below. The method further includes the step of expressing the heterologous nucleic acid sequence in the microbial cell.

The microbial cell can be any microbial cell from which 2' fucosyllactose can be exported. In certain embodiments, the microbial cell is a bacterial cell or a fungal cell. In particular embodiments, the bacterial cell is of the genus such Escherichia, Bacillus, Methylomonas, Pseudomonas. Lactobacillus, or Corynebacterium. In various embodiments the microbial cell is an Escherichia coli or Bacillus subtilis cell. In certain embodiments, the microbial cell is a yeast cell. In certain embodiments, the yeast cell is of the genus Saccharomyces, Yarrowia, Kluyveromyces, Candida, Hansenula, Pichia, Schizosaccharomyces, Zygosaccharomyces, Debaryomyces, Brettanomyces, Pachysolen, Issatchenkia, Trichosporon, or Yamadazyma. In various embodiments the yeast cell is from Saccharomyces cerevisiae, Yarrowia lipolytica or Kluyveromyces lactis.

A microbial cell may be genetically engineered to include and express a heterologous nucleic acid sequence by methods known in the art. One method of genetically engineering a microbial cell involves introducing genetic modifications in the cell that increase expression of a polypeptide encoded by a heterologous nucleic acid sequence. The expression of the polypeptide in the microbial cell prior to the genetic modification may be zero, or it may be detectable. The increased expression of the polypeptide encoded by the heterologous nucleic acid sequence can result in an increased polypeptide activity. Where the heterologous nucleic acid sequence encodes a polypeptide with the ability to export 2'FL, increased expression of the polypeptide, and the associated increase in polypeptide activity, can result in increased export of 2'FL from the cell.

To genetically modify a microbial cell to express a polypeptide encoded by a heterologous nucleic acid sequence, the coding sequence for the desired polypeptide is readily obtained from the genome of the cell in which it is natively expressed, as well known to one skilled in the art. In addition, coding sequences may be optionally synthesized using codon optimization for the target microbial cell. Typically, the nucleotide sequence encoding the amino acid sequence of the desired polypeptide is operably linked in a chimeric gene (or expression cassette) to a promoter that is active in the target microbial cell. Typically a transcription terminator is linked at the 3' end of the coding region. For example, for expression in a yeast cell, a number of yeast promoters can be used in constructing chimeric genes encoding a desired polypeptide, including, but not limited to, constitutive promoters FBA1, GPD1, ADH1, GPM, TPI1, TDH3, PGK1, Ilv 5, and the inducible promoters GAL1, GAL10, and CUP1. Suitable transcription terminators include, but are not limited to FBAt, GPDt, GPMt, ERG10t, GALIt, CYCIt, ADHIt, TALt TKLt, ILV5t, and ADHt. For bacterial expression, promoters and terminators that are active in the target host cell are used. In addition, multiple coding regions may be constructed together in an operon with a single promoter and termination signal.

A chimeric gene or operon for microbial cell expression is typically constructed in or transferred to a vector for further manipulations. The vector used is determined by the target host cell, and the transformation and/or integration methods to be used. Vectors for a target host cell are well known in the art. For example, for yeast expression, chimeric genes may be cloned into E. coli-yeast shuttle vectors, and transformed into yeast cells. These vectors allow propagation in both E. coli and yeast cells. Typically the vector contains a selectable marker and sequences allowing autonomous replication or chromosomal integration in the desired host. Plasmids for DNA integration may include transposons, regions of nucleic acid sequence homologous to the target genome, or other sequences supporting integration. An additional type of vector may be a transposome produced using, for example, a system that is commercially available from EPICENTRE®. It is well known how to choose an appropriate vector for the desired target host and the desired function. In addition, a selectable marker used to obtain transformed cells may be bounded by site-specific recombination sites, so that after expression of the corresponding site-specific recombinase, the resistance gene is excised from the genome. Multiple copies of a heterologous gene may be introduced on a plasmid or integrated into the cell genome.

There are many tests to determine if a genetically engineered microbial cell has increased export of 2'FL relative to a control cell. For example, the export of 2'FL from a strain that synthesizes it, can be measured by detecting it in the broth of fermentations under conditions in which the 2'FL is being synthesized inside the cell. The 2'FL can be detected directly by means of chromatography of clarified broth samples removed from the fermentation, followed by detection by, for example, evaporative light scattering detection. The 2'FL can also be detected in clarified broth samples indirectly by means of a coupled enzyme assay, first catalyzing hydrolysis of the 2'FL with an □-1,2-L-fucosidase enzyme (EC 3.2.1.63) and then catalyzing oxidization of the resulting fucose to fuconate with an NAD*-dependent L-fucose dehydrogenase enzyme (EC 1.1.1.122), and detecting the product NADH spectrophotometrically. 2'FL export may be measured indirectly based on a change in pH if the heterologous nucleic acid sequence encodes a protein which moves H+ during 2'FL export. The use of antibodies to detect products of fermentation reactions by ELISA-type assays are well known in the art, as is the analogous use of RNA-aptamers specific for the desired product. Higher throughput screens could be available by screening the growth rates of strains engineered to make 2'FL with different heterologous nucleic acid sequences, as it is to be expected that buildup of an osmolyte such as 2'FL will cause stress that will inhibit cell growth, or that buildup of pathway intermediates will be otherwise deleterious to cell growth.

The export of 2'FL from a genetically engineered microbial cell expressing the heterologous nucleic acid sequence is compared to the export of 2'FL from a control cell that does not express the heterologous nucleic acid sequence. In certain embodiments, the control cell does not express the heterologous nucleic acid sequence because the control cell has not been genetically engineered to contain the heterologous nucleic acid sequence. In certain embodiments, the control cell contains the heterologous nucleic acid sequence, but expression of the heterologous nucleic acid sequence has not been induced in the control cell. In certain embodiments, the control cell is the same cell as the cell expressing the heterologous nucleic acid sequence and the comparison is carried out by measuring 2'FL at different times, e.g., prior to and after inducing expression of the heterologous nucleic acid sequence. In certain embodiments, the control cell is a different cell than the cell genetically engineered to express the heterologous nucleic acid sequence. The control cell is a cell of the same genus and species as the cell genetically engineered to express the heterologous nucleic acid sequence.

Expression of the heterologous nucleic acid sequence in the microbial cell can increase export of 2' fucosyllactose to any amount relative to the level of export of 2' fucosyllactose in a control cell that does not express the heterologous nucleic acid sequence. In certain embodiments, expression of the heterologous nucleic acid sequence increases export of 2' fucosyllactose to at least 1.5×, preferably at least 2.0×, more preferably at least 2.5×, most preferably at least 3.0× the level of export in the control cell. In other embodiments total 2' fucosyllactose produced will be about 10 g/l to about 50 g/l where about 20 g/l to about 40 g/l is expected and where about 15, 16, 17, 18, 19, 20, 21, 22, 23, 24, 25, 26 or 27 g/l is generally be observed.

The heterologous nucleic acid sequence can be a nucleic acid sequence derived from any organism. In preferred embodiments, the heterologous nucleic acid sequence includes a nucleic acid sequence which encodes a protein derived from a bacterium or a fungus. In particular embodiments, the bacterium is of the genus *Escherichia, Bacillus, Methylomonas, Pseudomonas, Lactobacillus*, or *Corynebacterium*, including nucleic acid sequences encoding proteins from *Escherichia coli* or *Bacillus subtilis*. In certain embodiments, the nucleic acid sequence encodes a protein from a fungus of the genus *Saccharomyces, Yarrowia, Kluyveromyces, Candida, Hansenula. Pichia, Schizosaccharomyces, Zygosaccharomyces, Debaryomyces, Brettanomyces, Pachysolen, Issatchenkia, Trichosporon*, or *Yamadazyma*, including nucleic acid sequences encoding proteins from *Saccharomyces cerevisiae, Yarrowia lipolytica* or *Kluyveromyces lactis*. In a particularly preferred embodiment, the nucleic acid sequence encodes a protein from *Neurospora crassa*.

In certain embodiments, the bacterial or fungal protein is a transport protein. Various different types of transport proteins are known in the art and are often referred to as "transporters." Membrane transport proteins are classified by the Transporter Classification (TC) system (Saier et al. (2009) Nucl. Acids Res. 37:D274-8), approved by the International Union of Biochemistry and Molecular Biology, and analogous to the Enzyme Commission (EC) system for classifying enzymes. There are several general classes of transporters that are known. Channel-type facilitators carry out their activity by facilitated diffusion of the transported molecule from one side of the membrane to the other. Because this process does not generally involve transduction of energy, net transport is down the activity gradient (usually the concentration gradient) of the molecule being transported. In that sense, channel-type facilitators are not directional. An example of a transporter that acts by facilitated diffusion is the LamB maltoporin of *E. coli*, which is also an example of a Major Facilitator Superfamily (MFS) protein of classification TC 1.B.3.1.1. Electrochemical potential driven transporters include uniporters, symporters, and antiporters that utilize a chemiosmotic gradient to drive transport. In certain embodiments, the bacterial or fungal protein includes a uniporter, symporter, or antiporter such as the *E. coli* SetA antiporter or the *N. crassa* CDT2 uniporter, both of which are shown to effectively transport 2'FL from yeast cells (Example 6, below). In certain embodiments, the transport protein is a transport protein disclosed herein, or, in certain embodiments, a protein which includes an amino acid sequence which has a particular percentage identity to a transport protein disclosed herein. The transport protein can have any percentage identity to a protein disclosed to herein, such as the percentage identities described above, so long as the transport protein maintains the 2'FL export function. In a particular embodiment, the bacterial or fungal protein includes an amino acid sequence having at least 70%, at least 75%, at least 80, at least 85%, at least 90%, at least 91%, at least 92%, at least 93%, at least 94%, at least 95%, at least 96%, at least 97%, at least 98%, or at least 99% identity to the *E. coli* SetA (SEQ ID NO: 88) or *N. crassa* CDT2 (SEQ ID NO: 66) proteins, respectively.

In certain embodiments, when the microbial cell is a yeast cell, it is desirable to facilitate localization of a protein encoded by the heterologous nucleic acid sequence to the yeast plasma membrane. In certain embodiments, the heterologous nucleic acid sequence includes a nucleic acid sequence which encodes an amino acid sequence which facilitates localization of the heterologously expressed protein to the yeast plasma membrane. Nucleic acid sequences encoding amino acid sequences which facilitate localization of a protein to the yeast plasma membrane are known in the art. Amino acid sequences may facilitate localization to the membrane by providing sequences targeted for lipidation, forming an amphipathic helix, having affinity for membrane phospholipids, or forming a transmembrane helix. Sequences subject to the lipidation processes of palmitoylation (Ramos et al. (2011) Biochimica et Biophysica Acta 1808: 2981-2984) and myristoylation (Martin et al. (2011) Biochimie 93: 18-31) are known in the art. Onken et al.

((2006) PNAS 103: 9045-9050) disclose that the C-terminal region of the Rit protein can serve as an amphipathic helix which can faciliate localization of a protein to the yeast plasma membrane. The amino acids of the plextrin homology domain have been shown to facilitate protein localization to the plasma membrane through interaction with phosphoinositides in the plasma membrane (Garrenton et al. (2010) PNAS 107: 11805-11810). An example of an amino acid sequence that forms a transmembrane helix is the amino acid sequence of a SNARE protein, Sso1, which has previously been used to facilitate insertion of a heterologous protein, MerC, into the membrane (Kiyono et al. (2010) Appl. Microbiol. Biotechnol. 86: 753-759). It has also been shown that secretion of heterologously expressed proteins can be enhanced by overexpression of SNARE proteins in the yeast host (Ruohonen et al. (1999) Yeast 13: 337-351; U.S. Pat. No. 5,789,193).

As shown in FIG. 1, one method of producing 2'FL uses an □-1,2-fucosyltransferase to catalyze the combination of lactose and GDP-fucose. In certain embodiments, it is expected that increasing the ability of a microbial cell to import lactose will result in increased 2'FL within the microbial cell resulting in greater 2'FL available for export. In certain embodiments, the genetically engineered microbial cell, such as a genetically engineered yeast cell, includes a nucleic acid sequence which codes for a lactose transporter. The lactose transporter can be any lactose transporter known in the art that can be expressed in the microbial cell and facilitate uptake of lactose into the cell. In certain embodiments, the lactose transporter is a lactose transporter disclosed herein or a lactose transporter having an amino acid sequence with a particular percentage identity, such as the percentage identities described above, to a lactose transporter disclosed herein. In a particularly specific embodiment, the lactose transporter is a transporter which includes an amino acid sequence having at least 70%, at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 27.

In certain embodiments, the genetically engineered microbial cell is a cell that is genetically engineered to produce 2'FL, i.e., is a 2'FL producing cell. Methods for genetically engineering E. coli cells to produce 2'FL have been previously described (Lee et al. (2012) Microb. Cell Factories 11, 48-57; Baumgartner et al. (2013) 12, 40-53; US Patent Application 20140024820). Methods for genetically engineering yeast cells, such as yeasts of the genera Saccharomyces, Yarrowia, Kluyveromyces, Pichia, and Hansenula, to produce 2'FL are disclosed herein. In certain embodiments, yeast cells capable of producing 2'FL are constructed as described in Examples 4 and 8. Specifically, the Examples disclose a method in which the 2'FL producing yeast cells are made by expressing heterologous coding regions for GDP-mannose-4,6-dehydratase (GMD; EC 4.2.1.47), GDP-4-keto-6-D-deoxymannose epimerase-reductase (GDP-L-fucose synthase; GMER; EC 1.1.1.271), and 2-□-L-fucosyltransferase (2FT EC 2.4.1.69) in a yeast host that has a native pathway to GDP-mannose, and then supplying a source of lactose for the 2FT reaction. The native yeast pathway to GDP-mannose optionally may be enhanced by increasing expression of the endogenous pathway enzymes using methods described below. This pathway is shown in FIG. 1. Expression of the heterologous sequences in the microbial cells can be carried out as described above for the expression of the heterologous sequence which increases 2'FL export.

In various embodiments, further genetic engineering modifications are made to the yeast host cell to improve the efficiency of production of 2'FL. In certain embodiments, modifications are made to improve carbon flow through the introduced pathway which may include but are not limited to knocking out pathways that compete for key intermediates of the present pathway and/or redirecting reducing equivalents to the present pathway.

Yeast cells genetically engineered to produce 2'FL are 2'FL producing yeast cells.

In another aspect, the disclosure provides a method of identifying a heterologous nucleic acid sequence that, when expressed in a microbial cell, increases export of 2'FL from the microbial cell. The method includes the steps of obtaining a 2'FL producing yeast cell, expressing a candidate heterologous nucleic acid sequence in the 2'FL producing yeast cell such that a screening cell is produced, growing the screening cell in growth medium under conditions where 2'FL is present in the growth medium, determining an amount of 2'FL in the growth medium, and identifying the candidate heterologous nucleic acid sequence as a sequence which increases export of 2'FL if the amount of 2'FL in the growth medium is increased relative to a control cell that does not express the candidate heterologous nucleic acid sequence.

2'FL producing yeast cells may be obtained as described above for the production of a 2'FL producing yeast cell. Candidate heterologous nucleic acid sequences may be expressed in the 2'FL producing yeast cell as described above for the expression of a heterologous nucleic acid sequence which increases export of 2'FL.

A number of different methods may be used to identify nucleic acid sequences to express as candidate heterologous nucleic acid sequences. In certain embodiments, candidate heterologous nucleic acid sequences include a nucleic acid sequence which codes for a transporter known to transport a saccharide which is structurally analogous to 2'FL. Such transporters include, but are not limited to, transporters for maltotetraose, maltotriose, cellodextrose, lactose, sucrose, glucose, galactose, and other mono- di-, tri-, tetra- and larger polysaccharides. In certain embodiments, candidate heterologous nucleic acid sequences include a nucleic acid sequence which codes for a transporter from an organism which uses an HMO as a carbon source. Candidate nucleic acid sequences may be identified from such organisms by genetic or biochemical means. In certain embodiments, the organism is a probiotic organism for which 2'FL serves as a prebiotic such as Bifidobacterium including Bifidobacterium bifidum and Bifidobacterium longum, and in particular, Bifidobacterium longum subsp. infantis. In particular embodiments, the candidate heterologous nucleic acid sequence includes a nucleic acid sequence which codes for an ABC transporter from Bifodobacterium longum subsp. infantis, e.g., a nucleic acid sequence which codes for a protein having an amino acid sequence selected from SEQ ID NOs:109-115. In certain embodiments, candidate heterologous nucleic acid sequences include a nucleic acid sequence which codes for a protein which falls within a family of known transport proteins. Exemplary transport protein families include, but are not limited to, the SWEET family of transporters, the SetA family of transporters, and the Sugar porter family of transporters. Individual family members may be identified by searching sequence databases with models representative of these transport protein families as described in further detail in Examples 1-3 below. Candidate heterologous nucleic acid sequences also include heterologous nucleic acid sequences which code for any transport protein disclosed herein and any protein having an amino acid sequence with at least 80%, at least 85%, at least 90%, at least 91%, at least 92%, at least 93%, at least 94%, at least 95%, at least 96%, at least 97%, at least 98%, or at least 99% identity to a transport protein disclosed herein.

2'FL producing yeast cells expressing a candidate heterologous nucleic acid sequence can be grown in any growth medium suitable for the growth of yeast cells and the production of 2'FL.

The growth medium will typically contain suitable carbon substrates, most typically glucose, but may contain non-fermentable carbon sources such as ethanol, glycerol or acetate. Carbon substrates may be provided by glucose preparations or by glucose and other sugars prepared from starch biomass or lignocellulosic biomass. A starch biomass, such as ground corn grain, is typically treated using alpha amylase and glucoamylase enzymes to prepare a hydrolyzed mash that can be used in the growth medium. A lignocellulosic biomass is typically pretreated with mechanical energy and chemicals, then hydrolyzed using multiple glycosidases including cellulases and other enzymes, such as disclosed in WO 2011/038019, to produce a lignocellulosic biomass hydrolysate containing glucose, xylose, and arabinose that can be used in the growth medium, for example as disclosed in U.S. Pat. No. 7,932,063. Carbon substrates may also be provided by non-carbohydrate feed stocks, e.g., media including ethanol, fatty acids, glycerol, etc. These feed stocks may be used in place of or in combination with more typical carbon substrates such as glucose. Growth medium for use with the genetically engineered cells disclosed herein may contain additional substrates that contribute to production of the desired product. For example, in certain embodiments, lactose is provided in the medium to induce production of 2'FL (see FIG. 1). These substrates are typically provided by batch feeding of the growth medium.

Specific fermentation conditions will be determined by the type of host cell used for production. One of skill in the art will be familiar with conditions such as pH, oxygenation, and temperature used for various bacterial and fungal cells. For example in one embodiment yeast fermentations may be run at a temperature of about 30 C to about 35 C and a pH of between about 5.0 and 6.5, where a pH of about 5.4, 5.5, 5.6, 5.7, 5.8, 5.9, 6.0, 6.1, 6.2, 6.3, and 6.4 will all be suitable. Alternatively the pH may be modulated during the fermentation from a lower pH to a high pH. For example the fermentation may be started at a pH of about 5.4 to about 5.6, where a pH of about 5.5 is preferred and then shifted at some point during the fermentation to a pH of about 6.0 to about 7.0 where a pH of about 6.3 is preferred. In one embodiment this shift in pH may be coincident with the addition an alternate carbon source. For example initial fermentations may be run under conditions of pH 5.5 and a carbon source selected from glucose, sucrose and fructose, and then, on the shift of pH to about 6.3 for example, the carbon source may be shifted to lactose.

The presence of 2'FL in the growth medium and/or the cell can be detected as described above. These methods can also be used to determine the amount of 2'FL in the growth medium. In certain embodiments, the amount of 2'FL in the growth medium is the absolute amount of 2'FL in the growth medium. In certain embodiments, the amount of 2'FL in the growth medium is a based on a calculation of the amount of 2'FL in the growth medium relative to the amount of 2'FL in the cell. Thus, in certain embodiments, a candidate heterologous nucleic acid sequence is identified as a heterologous nucleic acid sequence which increases 2'FL export if there is a greater absolute amount of 2'FL in the growth medium of the screening cell than in the growth medium of a control cell. In certain embodiments, a candidate heterologous nucleic acid sequence is identified as a heterologous nucleic acid sequence which increases 2'FL export if there is a relative increase in 2'FL in the growth medium. A relative increase in 2'FL in the growth medium can be identified, for example, by calculating a ratio of 2'FL in the growth medium of both the screening cell and the control cell to 2'FL in the respective cells, comparing the ratios, and identifying candidate heterologous nucleic acid sequences where the ratio for the screening cell is greater than the ratio for the control cell. One of skill in the art would recognize other methods for identifying a relative increase in 2'FL in the growth medium. In certain embodiments, the screening cell is grown for a period of time before the amount of 2'FL in the growth medium is determined. For example, the amount of 2'FL in the growth medium may be determined after 12 hours, 16 hours, 18 hours, 24 hours, 30 hours, 36 hours, 40 hours, 48 hours, 72 hours, or more of growth. Candidate heterologous nucleic acid sequences that, when expressed in the cell, increase the amount of 2'FL in the growth medium can be identified as a heterologous nucleic acid sequence that increases export of 2'FL. In certain embodiments, the candidate heterologous nucleic acid sequence is identified as a heterologous nucleic acid sequence which increases export of 2'FL when the amount of 2'FL in the growth medium is increased to at least 1.5×, preferably at least 2.0×, more preferably at least 2.5×, most preferably at least 3.0× the control.

2'FL exported from a microbial cell as disclosed herein can be isolated from growth medium and used in various food products, such as nutritional supplements. For example, the 2'FL can be added to formula for infants, toddlers, or children.

EXAMPLES

The disclosure is further defined in the following Examples. It should be understood that these Examples, while indicating preferred embodiments, are given by way of illustration only. From the above discussion and these Examples, one skilled in the art can ascertain the essential characteristics of this disclosure, and without departing from the spirit and scope thereof, can make various changes and modifications of the disclosure to adapt it to various uses and conditions.

General Methods

The meaning of abbreviations is as follows: "kb" means kilobase(s), "bp" means base pairs, "nt" means nucleotide(s), "hr" means hour(s), "min" means minute(s), "sec" means second(s), "d" means day(s), "L" means liter(s), "m" or "mL" means milliliter(s), "LIL" means microliter(s), "□g" means microgram(s), "ng" means nanogram(s), "mg" means milligram(s), "mM" means millimolar, "□M" means micromolar, "nm" means nanometer(s), "□mol" means micromole(s), "pmol" means picomole(s), Standard recombinant DNA and molecular cloning techniques used here are well known in the art and are described by Sambrook, J., Fritsch, E. F. and Maniatis, T., *Molecular Cloning: A Laboratory Manual*, $2^{nd}$ ed., Cold Spring Harbor Laboratory: Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley- Interscience, Hoboken, N.J. (1987), and by *Methods in Yeast Genetics,* 2005, Cold Spring Harbor Laboratory Press, Cold Spring Harbor, N.Y.

General Methods

Transformation of *Saccharomyces cerevisiae* Strains

*Saccharomyces cerevisiae* strains are made competent for transformation via protocols employing lithium acetate and polyethylene glycol (described in Amberg, D. C., Burke, D. J. and Strathem, J. N. Methods in Yeast Genetics: A Cold Spring Harbor Laboratory Course Manual, Cold Spring Harbor Press, 2005). In most cases, a commercial kit is used (e.g. Frozen EZ Yeast Transformation II Kit™, Zymo Research, Irvine, Calif.), though for some lineages a higher efficiency method such as that by Gietz et al. (1992, Nucleic Acids Res. 20(6): 1425) with extension of 42° C. incubation to 40 minutes is used for chromosomal integrations. Integration events are confirmed by PCR. Yeast cells from colonies or patches are introduced directly into PCR reactions (e.g. JumpStart Red Taq) or pretreated with Chelex® resin (BioRad, Hercules, Calif.) prior to PCR as follows. A sterile toothpick is used to transfer approximately one cubic millimeter of cells to 100 □l of 5% Chelex (w/v) suspended in ddH,O in a 0.2 ml PCR tube. Tubes are incubated at 99° C. for 10 min followed centrifugation for 3 min at 14000 rpm to pellet all cellular debris at the bottom of the tube.

Transformation of *Yarrowia lipolytica* strains

Transformation of *Y. lipolytica* was performed according to the method of Chen, D. C. et al. (Appl. Microbiol Biotechnol., 48(2):232-235 (1997)). Briefly, *Yarrowia* cells were streaked onto a YPD plate and grown at 30° C. for approximately 18 h. For each transformation, one loopful of cells was scraped from the plate and resuspended in 0.125 mL of transformation buffer containing: 2.25 mL of 50% PEG, average MW 3350; 0.125 mL of 2 M Li acetate, pH 6.0; and, 0.125 mL of 2 M DTT. Then, approximately 250 ng of circular plasmid DNA or 1000 ng of linear DNA was added to this cell suspension and incubated at 39° C. for 1 hr with vortex mixing at 15 min intervals. The cells were plated onto selective medium plates and maintained at 30° C. for 1 to 3 days.

Codon Optimization for *Yarrowia*

Genes were codon-optimized for expression in *Yarrowia* in a manner similar to that described in Int'l Ap. Pub. No. WO 2004/101753 and U.S. Pat. No. 7,125,672. Genes were optimized according to the *Yarrowia* codon usage pattern (Int'l Ap. Pub. No. WO 2004/101753), the consensus sequence around the ATG translation initiation codon, and the general rules of RNA stability (Guhanivogi and Brewer, Gene 265:11-23 (2001)).

Example 1

Identification of SWEET Transporters

The SWEET11 protein from *Arabidopsis thaliana* (SwissProt: SWT11_ARATH) was used as the starting sequence for identifying other SWEET family members. The *Arabidopsis* SWEET11 protein, annotated as bidirectional sugar transporter, belongs to the Pfam family pfam03083 in the Conserved Domain Database (CDD). This family includes several plant sugar efflux transporters as well as other transmembrane proteins of unknown function. Each SWEET protein appears to contain two domains of pfam03083.

An HMM, provided as Appendix 1, was constructed based on the pfam03083 family alignment from the CDD using hmmbuild, a utility from the HMMER package. The non-redundant version of the NCBI Protein Database (henceforth referred to as NR) was searched using hmmsearch, also from the HMMER package. At a whole sequence (multi-domain) E-value cutoff of 1e-10, the search resulted in 1937 hits. 8 of the 1937 NR hits were from fungi, they are shown below:
i. gi|575475786|ref|XP_006677187.1|hypothetical protein BATDEDRAFT_36766 [*Batrachochytrium dendrobatidis* JAM81]
ii. gi|575476392|ref|XP_006677490.1|hypothetical protein BATDEDRAFT_36766 [*Batrachochytrium dendrobatidis* JAM81]
iii. gi|635368375|emb|CCI43476.1|unnamed protein product [*Albugo candida*]
iv. gi|575481024|ref|XP_006679806.1|hypothetical protein BATDEDRAFT_12437, partial [*Batrachochytrium dendrobatidis* JAM81]
v. gi|635364470|emb|CCI47089.1|unnamed protein product [*Albugo candida*]
vi. gi|635364469|emb|CCI47088.1|unnamed protein product [*Albugo candida*]
vii. gi|528892555|gb|EPZ32924.1|hypothetical protein O9G_002842 [*Rozella allomycis* CSF55]
viii. gi|635362243|emb|CCI10456.1| unnamed protein product [*Albugo candida*]

A similar search against SwissProt, a reliably annotated protein database, resulted in 60 hits at an E-value cutoff of 1e-10 for whole sequence. All 60 of the hits are plant SWEET proteins.

Example 2

Identification of SetA-Like Transporters

The SetA family of proteins in the CDD is defined by the TIGR00899 family model. The TIGR00899 family was previously designated as 2A0120 in the CDD. SetA and a large number of other transporter families belong to the Major Facilitator Superfamily (MFS), defined by the CDD model cd06174.

An HMM, provided as Appendix 2, was built using the hmmbuild utility (HMMER package) from the TIIGR00899 alignment. The TIGR00899 HMM was used to search the NR database using the hmmsearch utility of the HMMer package. This search yielded 3818 hits at an E-value cutoff of 1e-10. A similar search against SwissProt yielded 49 hits at the same E-value cutoff. One of the 3818 NR hits was from a fungus, specifically, the fungal strain *Mucor circinelloides* f. *circinelloides* 1006PhL.

Example 3

Identification of Sugar Porter Family Transporters

The 'Sugar porter' family is defined in the CDD by the TIGR00879 model. An HMM, provided as Appendix 3, was generated based on the TIGR00879 alignment using hmmbuild (HMMER package). The HMM was used to search the NR database using the hmmsearch utility (HMMER package). This search resulted in 60,509 hits at an E-value cutoff of 1e-10. Many of the hits overlapped with the search using the SetA family HMM (Example 2). An E-value cutoff of 1e-100 was therefore used. The search was further focused only on sequences from fungi. 5023 fungal sequences, representing 802 genera, were identified in this manner.

Example 4

Construction of 2'Fucosyllactose-Producing *Saccharomyces cerevisiae* Strains Integration of Lactose Permease Gene A nucleic acid molecule having the coding sequence for the lactose permease from *Kluyveromyces lactis* (LAC12) was obtained from a commercial gene synthesis company (IDT, Coralville, Iowa)(SEQ ID No: 116). The linear fragment was cloned into pCRII-Blunt (TOPO) vector (Zero Blunt TOPO cloning vector, Invitrogen) per the manufacturer's instructions. Clones were sequenced. The LAC12 coding region was PCR amplified using primers H89 and H94 (SEQ ID NOs:117 and 118), and this nucleic acid fragment was joined to promoter and terminator sequences using PCR The PMA1 promoter (SEQ ID NO:119) was amplified from *S. cerevisiae* genomic DNA using primers H92 and H93 (SEQ ID NOs:120 and 121). The TPS1 terminator (SEQ ID NO:122) was amplified from *S. cerevisiae* genomic DNA using primers H90 and H91 (SEQ ID NOs:123 and 124). The fused promoter, coding region and terminator were amplified with H91 and H92, digested with BamHI and PmeI, and cloned into pUC19-URA3-YPRCΔ15 (SEQ ID NO:125: described in US Patent Application Publication No. 20130203138, which is incorporated herein by reference), previously digested with BamHI and PmeI. Ligation mixtures were transformed into *E. coli* Stbl3 cells (Life Technologies). Colonies arising with ampicillin selection (100 □g/mL) were screened by PCR to confirm the LAC12 clones. Positive clones were sequenced. A clone with confirmed sequence was linearized with SphI and transformed into strain PNY1500 (also called BP857; described in U.S. Pat. No. 8,871,488) which is a ura3□ his3□ variant of CEN.PK 113-7D. Cells were plated on synthetic complete medium without uracil. Colonies were screened for the expected integration event using primers BK1042 and H95 for the 5' end (SEQ ID NOs:126 and 127), and BK1043 and 92 for the 3' end, (SEQ ID NOs:128 and 129). Two clones were selected for marker recycling, as follows. Clones were grown overnight in yeast extract-peptone-dextrose (YPD) medium, and then streaked onto synthetic complete medium containing 0.1% 5-fluoroorotic acid (5-FOA). Colonies were patched to synthetic complete medium without uracil to confirm lack of growth without uracil (i.e. loss of the URA3 auxotrophic marker). Uracil auxotrophic clones were evaluated by PCR (using primers BK1043 and H96, SEQ ID NO:130) to confirm that the URA3 marker was removed via homologous recombination. Multiple clones were tested for lactose consumption upon transformation with the pHR81-LAC4 plasmid described below. One clone that was able to grow on lactose was designated HS0003.

Beta-galactosidase is temporarily expressed to test for lactose permease activity. The coding sequence for beta-galactosidase from *Kluyveromyces lactis* (SEQ ID NO:163) was obtained from a commercial gene synthesis company (IDT, Coralville, Iowa). Due to its size, the coding sequence was ordered in two overlapping nucleic acid fragments (5' fragment and 3'fragment: SEQ ID NOs:131 and 132, respectively). The linear fragments were each cloned into pCRII-Blunt (TOPO) vector (Zero Blunt TOPO cloning vector, Invitrogen) per the manufacturer's instructions. Clones were sequenced. One clone for each plasmid was selected and the two gene fragments were amplified by PCR with primers (H98 and M13ForTOPO for the 5' fragment and M13RevTOPO and H99 for the 3 fragment, SEQ ID NOs: 133-136). An expression plasmid was assembled using gap repair cloning methodology as follows. The gene fragments were combined with PmeI digested pHR81-ILV5p-R8B2y2 (SEQ ID NO:137; described in US20130252296), which contains the ILV5 promoter and terminator (SEQ ID NOs: 138 and 139), and transformed into PNY1500 ypr□15□::LAC12 cells. Transformants were obtained via selection on synthetic complete medium lacking uracil. Colonies were subsequently patched to medium containing lactose as the carbon source. Proper assembly of the expression plasmid (named pHR81::ILV5p-LAC4-ILV5t) was also confirmed using PCR and correlated with the ability to grow on lactose.

Construction of Plasmids Encoding GDP-Mannose Dehydratase and GDP-4-Keto-6-Deoxymannose Epimerase Reductase Nucleic acid molecules having the coding sequences for GDP-mannose dehydratase (GMD) and GDP-4-keto-6-deoxymannose epimerase reductase (GMER) from *E. coli* were obtained from a commercial gene synthesis company (IDT, Coralville, Iowa) (SEQ ID NOs:140 and 141). The linear gene fragments were cloned into pCRII-Blunt (Zero Blunt TOPO cloning vector, Invitrogen) per the manufacturer's instructions. Clones were sequenced. One clone for each gene was used as a PCR template to add 5' and 3' extensions to the genes to allow subsequent cloning by homologous recombination (gap repair cloning). These primers were H17 and H18 (SEQ ID NOS:142 and 143) for GMD and H15 and H16 (SEQ ID NOS:144 and 145) for GMER. The recipient vector was prepared in two fragments from pRS413::BiADH-kivD (described in WO 2014/151645; SEQ ID NO: 98 therein): a 6 kb fragment (PacI/PmeI) and a 2.8 kb fragment (NcoI/EcoRV). The two coding region fragments and the two vector fragments were combined and transformed into PNY1500. Transformants were obtained via selection on synthetic complete medium lacking histidine. The resulting plasmid contained two gene cassettes—one expressing GMD from the PDC promoter (SEQ ID NO:146) with the ADH1 terminator (SEQ ID NO:147) and one expressing GMER from a hybrid promoter (PGK1(UAS)-FBA1) (SEQ ID NO:148) with the TDH3 terminator (SEQ ID NO:149). Correct plasmid clones were confirmed by sequencing. One plasmid was designated pRS413::GMD-GMER_Ec.

An additional version of the GMD-GMER expression plasmid was constructed by replacing the HIS3 selectable marker with URA3. The plasmid was linearized with NheI and the URA3 marker from pRS416 (ATCC #87521) was amplified by PCR using primers N236 and N237 (SEQ ID NOs:150 and 151). The vector fragment and linear gene fragment were combined and transformed into HS0003 to be assembled by gap repair cloning. One resulting clone was designated pRS416::GMD-GMER_Ec.

Construction of Plasmid Encoding □1,2-Fucosyltransferase

A nucleic acid molecule having the coding sequence for a FutC enzyme from *Helicobacter pylori* was obtained from a commercial gene synthesis company (IDT, Coralville, Iowa) (SEQ ID NO:152). The linear gene fragment was cloned into pCRII-Blunt (Zero Blunt TOPO cloning vector, Invitrogen) per the manufacturer's instructions. Clones were sequenced using standard M13 forward and reverse primers. One clone was digested with BsaI and the futC coding region fragment was cloned into pY-SUMOstar (Life Sensors, Malvern, Pa.) also previously cut with BsaI. Ligation mixtures were transformed into *E. coli* Stbl3 cells. Colonies arising with ampicillin selection (100 □g/mL) were screened by PCR to confirm the futC clones.

In order to use the pY-SUMOstar-based plasmid in *Saccharomyces* (with TRP1 selection), the TRP1 gene was deleted from strain HS0003. The gene was deleted using an integration construct described in the following section. The integration construct was introduced into strain HS0003 and transformants were selected on synthetic complete medium lacking uracil. Transformant colonies were patched to synthetic complete medium lacking tryptophan to confirm the deletion. Recycling of the URA3 selectable marker was accomplished by growing two clones overnight in YPD medium and then streaking for isolated colonies on synthetic complete plates supplemented with 5-FOA. Several colonies were patched to synthetic complete medium lacking uracil or tryptophan to confirm marker removal (Ura minus phenotype) and retention of the Trp minus phenotype. After recycle, the locus carries a scarless 454 bp deletion in the TRP to ORF, starting at bp 12. One clone was designated HS0009. The pY-SUMOstar::futC_Hp plasmid was transformed along with pRS416::GMD-GMER_Ec and pRS413 into HS0009. Transformant colonies were evaluated for production of 2'FL, as described in Example 5. One clone was designated HS0012.

pTRP1-KO-URA3

A pBlueScript plasmid previously modified to contain the URA3 gene from *S. cerevisiae* was further modified to contain DNA sequences targeting URA3 to the TRP1 locus. Genomic DNA prepared from *S. cerevisiae* S288c, (sequence available from NCBI referencing ATCC 204508) was used as template for three PCR reactions as follows. A 0.2 kb 5' TRP1 fragment was amplified using primers TRP1-KO-1 and TRP1-KO-2 (SEQ ID NOs:153 and 154), and this was cloned 3' of the URA3 gene (at the XbaI/BamHI sites). A 0.5 kb 5' TRP1 fragment (5' of the first fragment) was amplified using primers TRP-KO-3 and TRP1-KO-4 (SEQ ID NOs:155 and 156). This was digested with SalI and AseI. A 0.4 kb 3' TRP1 fragment was amplified using primers TRP1-KO-5 and TRP1-KO-6 (SEQ ID NOs: 157 and 158). This was digested with AseI and KpnI. The two digested PCR products were ligated into the previous vector already containing the first 5' TRP1 fragment at the SalI/KpnI sites. The resulting plasmid was confirmed by PCR. The plasmid was digested with XbaI and BglII to liberate a 2.6 kb integration cassette (SEQ ID NO. 159), which was used in the transformation of HS0003 as described in the paragraph directly above.

Example 5

Intracellular and Extracellular Measurement of 2'FL

Strains transformed with plasmids carrying 2'FL pathway genes (Example 4) were evaluated in shake flasks. Clones, e.g., HS0012 and siblings, were inoculated into synthetic complete medium without histidine, tryptophan and uracil and incubated at 30° C. with agitation (200 rpm, Infors Multitron platform shaker). Overnight cultures were adjusted to 0.1 to 0.2 OD (Beckman BioPhotomter, Hamburg Germany) and grown to an OD of approximately 1. Lactose was added to 0.5% (w/v) and copper sulfate was added (100 □M) to increase the expression of FutC_Hp, which is under control of the CUP1 promoter. At various times post-induction, culture samples (ca. 2-10 mL) were centrifuged to separate cells from medium. The cell pellets were frozen at −80° C. Culture supernatants were filtered through 0.22 micron Costar Spin-X filter tubes (Corning, Corning, N.Y.) or AcroPrep™ Advance 96 filter plates (Pall, Ann Arbor, Mich.) and stored at −20° C.

Intracellular Detection of 2'FL

Cell pellets were thawed at room temperature just prior to use. An aliquot of 0.425 mL of 0.2 µm filtered NanoPure water was added to each thawed cell pellet, and the pellet was resuspended by pipetting up and down. The suspension was transferred to a 1.5 mL microcentrifuge tube. The sample was heated at 98° C. on a heat block (Eppendorf) for six minutes, cooled briefly on ice, vortexed, and centrifuged at 10,000×g for 10 minutes. An aliquot of 40 µL of the resulting supernatant was added to a new microcentrifuge tube and diluted with the addition of 80 µL of acetonitrile. The 120 µL of acetonitrile-diluted supernatant was transferred to the top of a Nanosep MF Centrifugal Device, 0.2 µm (Pall) which was then centrifuged at 10,000×g for one minute. The filtrate was added to a LC vial with a low volume insert.

Samples were analyzed by UHPLC-ELSD (Shimadzu Nexera X2). The column used was an Acquity UHPLC BEH Amide 1.7 µm, 2.1×100 mm (Waters) with a Waters guard column of the same material. The injection volume for each sample was 4 µL. Buffer A was 10% acetonitrile in water, and Buffer B was 100% acetonitrile. A gradient elution was run that involved an initial hold of 25% Buffer A for 2.3 min, followed by a gradient to 60% Buffer A at 6.5 min, followed by a gradient to 90% Buffer A at 7.00 min and a hold of this percentage to 7.5 min, and then a re-equilibration to 25% Buffer A to 10.0 min. Standard runs with D-(+)-glucose (Sigma-Aldrich G7528 Lot SLBK8673V), a-lactose monohydrate (Carbosynth OL050091401), 2'FL (Carbosynth OF067391403), and lactodifucotetraose (LDFT, Carbosynth OL065671201) resulted in retention times of 1.8 minutes, 3.3 minutes, 4.4 minutes, and 5.4 minutes respectively. Calibration curves were run for these components and were used to produce raw concentration data. $OD_{600}$ values and the sample amounts were used to normalize the intracellular concentrations as follows:

Normalized mM=(Raw mM)*(0.425 mL+ (OD*$V_{centrifuged}$*0.0009594 mL $OD^{-1}$))/ (OD*$V_{centrifuged}$*0.0009594 mL $OD^{-1}$).

The 0.0009594 mL/OD factor was estimated based on a haploid cell volume (Sherman. "Getting started with yeast", Methods in Enzymology (2002) 350:3-41). Alternatively, data may be normalized to the cell culture volume from which the cells were harvested for comparison to extracellular concentrations.

TABLE 4

Intracellular 2'FL mM) measured for strain HS0012, described in Example 4.

|  | 24 h | Std Dev | 48 h | Std Dev |
| --- | --- | --- | --- | --- |
| Test 1 | 63.5 | 3.7 | 27.6 | 1.5 |
| Test 2 | 49.2 | 1.6 | 26.1 | 0.8 |

Extracellular Detection of 2'FL

Extracellular 2'-fucosyl lactose was measured with an enzyme based fluorometric assay. Yeast culture supernatants were filtered using Spin-X 0.22 □M Nylon tube filters and 100 □l of filtrates were diluted two fold into 202 mM sodium phosphate pH 6, containing 1.51 units of *T. maritima* fucosidase (E-FUCTM, Megazyme International Ireland). The mixtures were incubated at 90° C. for 10 minutes. The amounts of fucose in the resultant solutions were measured with the L-fucose assay kit (K-Fucose, Megazyme International Ireland), based on fucose dehydrogenase catalyzed oxidation of fucose with concomitant reduction of NADP. 26.2 □l of fucosidase treated samples were diluted 10 fold in the fucose dehydrogenase reaction mixture, prepared according to the vendor. The solutions were incubated for 19 min at 37° C. NADPH fluorescence was then measured in a Wallac 1420 Victor3 Microplate Reader (Perkin Elmer), employing a 355 nm cut-off filter for excitation and 450 nm filter for emission. A fucose standard was employed to calculate fucose formed in each reaction. Samples with and without fucosidase were compared to specifically quantitate the amounts of fucose generated during the fucosidase treatment step, providing extracellular 2'fucosyllactose concentrations in the supernatants.

TABLE 5

Extracellular 2'FL (□M) measured for strain HS0012, described in Example 4.

|  | 24 h | Std Dev | 48 h | Std Dev |
|---|---|---|---|---|
| Test 1 | 367.3413 | 11.49446 | 1146.787 | 114.6548 |
| Test 2 | 538.8621 | 174.2764 | 1201.908 | 19.02298 |

Example 6

Evaluation of Transporter Candidates in 2'FL-Producing Saccharomyces Strains

Saccharomyces cerevisiae AGT1 encodes a transporter of maltotriose, trehalose, and sucrose. The Saccharomyces cerevisiae AGT1 coding region from CEN.PK 113-7D (SEQ ID NO:164) (Entian K D, Kötter P: Yeast genetic strain and plasmid collections. Method Microbiol 2007, 36:629-666) was amplified with primers H415 and H416 (SEQ ID NOs:160 and 161). The primers added flanking sequence for homologous recombination into a vector, originally derived from pRS413 (ATCC #87518) containing the FBA(L8) promoter (SEQ ID NO:162: described in Patent Application WO2014/151645) and ADH1 terminator. The resulting pRS413::FBA(L8)-AGT1 plasmid was obtained after transforming the linear coding region and vector fragments into PNY1500 and selecting for histidine prototrophy. Clones were identified by colony PCR (screening primers) and then the AGT1 gene was sequenced in four clones. One clone was selected for further evaluation (designated pLMH101, SEQ ID NO:165)

Additional Transporter Plasmids

Eighteen transporter candidates were identified by bioinformatics, as described in Examples 1-3, to represent plant and fungal Sweet homologs as well as a subset of MFS family transporters (homologs of sugar-phosphate efflux antiporter SetA and a yeast maltotriose symporter MAL21). DNA sequences encoding the transporters were codon optimized and obtained from a commercial gene synthesis company (GenScript, Piscataway, N.J.). (SEQ ID NOs: 166, 169-184, and 187, Tables 6-7). The pLMH101 vector, described above, was sent to GenScript (Piscataway, N.J.) for custom gene cloning of each candidate transporter at the PmeI/PacI sites (i.e. replacing the AGT1 open reading frame).

Plasmids obtained from GenScript were transformed with pY-SUMOstar::futC_Hp and pRS416::GMD-GMER_Ec into strain HS0009 (strain and plasmids described in Example 4). Transformants were selected by plating on synthetic complete medium without uracil, histidine and tryptophan. Three colonies from each transformation plate were evaluated for 2'FL production as described in Example 5. Sixteen candidate transporters were evaluated in a first experiment, and two additional transporters were evaluated in a second experiment. The average ratios of internal to external 2'FL are reported in Tables 6-7.

TABLE 6

Intracellular to extracellular ratio of 2'FL from candidates tested in the first experiment. Results are given at two different time points. Strains expressing the indicated transporter are described in Example 6 and internal and external 2'FL concentrations are determined as described in Example 5. The ratios were calculated by normalizing the intracellular measurements to the amount of culture from which the cells were harvested. Ratios represent the average of biological triplicate experiments.

| Transporter; SEQ ID NO | 24 h ratio | 48 h ratio |
|---|---|---|
| HGS52; 180 | 0.500927 | 0.109728 |
| HGS53; 175 | 0.589502 | 0.147714 |
| HGS54; 178 | 0.66994 | 0.138867 |
| HGS55; 173 | 0.626867 | 0.145235 |
| HGS56; 174 | 0.658991 | 0.166641 |
| HGS57; 169 | 0.812454 | 0.162982 |
| HGS58; 176 | 1.582828 | 0.150922 |
| HGS60; 177 | 0.943534 | 0.175263 |
| Control (HS0012) | 1.331595 | 0.275269 |
| HGS61; 170 | 0.522332 | 0.133822 |
| HGS62; 171 | 0.782394 | 0.126209 |
| HGS63; 172 | 1.038829 | 0.676364 |
| HGS64; 182 | 0.66499 | 0.117643 |
| HGS65; 181 | 3.240054 | 0.243089 |
| HGS66; 166 | 0.048524 | 0.013367 |
| HGS67; 184 | 0.722871 | 0.111634 |
| HGS69; 187 | 0.606278 | 0.109589 |
| Control (HS0012) | 0.858476 | 0.262333 |

TABLE 7

Intracellular to extracellular ratio of 2'FL from candidates tested in the second experiment. Results are given at two different time points. Strains expressing the indicated transporter are described in Example 6 and internal and external 2'FL concentrations are determined as described in Example 5. The ratios were calculated by normalizing the intracellular measurements to the amount of culture from which the cells were harvested. Ratios represent the average of biological triplicate experiments.

| Transporter; SEQ ID NO | 24 h ratio | 48 h ratio |
|---|---|---|
| HGS59; 179 | 0.207898 | 0.056849 |
| HGS68; 183 | 0.206155 | 0.061209 |
| Control (HS0012) | 0.13892 | 0.059779 |

A subset of the transporter candidates from Table 6 were further tested for 2'FL export under glucose-limited conditions. This was achieved using glucose FeedBeads (Kuhner Shaker, catalog number SMFB63319). Cultures were maintained essentially as described in Example 5, except that a single feed bead was added to each culture at approximately 12-hour intervals. No additional glucose was present at the time of inoculation. Extracellular to intracellular ratio results are provided in Table 8.

TABLE 8

Extracellular to intracellular ratio of 2'FL at two time points. Strains expressing the indicated transporter and growth conditions are described in Example 6. The ratios were calculated by normalizing the intracellular measurements to the amount of culture from which the cells were harvested. Ratios represent the average of duplicate shake flasks for a single clone of each genotype.

| Transporter; SEQ ID NO | 24 h ratio | 48 h ratio |
|---|---|---|
| HGS52; 180 | 0.37 ± 0.07 | 1.3 ± 0.4 |
| HGS53; 175 | 0.30 ± 0.06 | 1.5 ± 0.9 |
| HGS54; 178 | 0.3 ± 0.1 | 1.1 ± 0.3 |

TABLE 8-continued

Extracellular to intracellular ratio of 2'FL at two time points. Strains expressing the indicated transporter and growth conditions are described in Example 6. The ratios were calculated by normalizing the intracellular measurements to the amount of culture from which the cells were harvested. Ratios represent the average of duplicate shake flasks for a single clone of each genotype.

| Transporter; SEQ ID NO | 24 h ratio | 48 h ratio |
| --- | --- | --- |
| HGS62; 171 | 0.30 ± 0.02 | 1.64 ± 0.05 |
| HGS66; 166 | 0.85 ± 0.02 | 2.2 ± 0.5 |
| Control (HS0012) | 0.4 ± 0.2 | 2.4 ± 0.5 |

Example 7

Evaluation of Additional Transporter Candidates

Four transporter candidates were selected by bioinformatics that represent cellodextrin transporters (MFS family. HGS71 and HGS72) and multidrug efflux pumps (RND family, HGS73 and HSG74). DNA sequences encoding the transporters were codon optimized and obtained from a commercial gene synthesis company (GenScript, Piscataway, N.J.). (SEQ ID NOs: 167-168, 185-186.Table 9). The pLMH101 vector, described above, was sent to GenScript (Piscataway, N.J.) for custom gene cloning of each candidate transporter at the PmeI/PacI sites (i.e. replacing the AGT1 open reading frame).

Strains were constructed as described above in Example 6 and were subsequently evaluated for 2'FL production as described above in Example 5. Extracellular to intracellular 2'FL ratios for the strains are provided in table 9. One clone containing the transporter CDT2 (HGS72) was designated HS0014.

TABLE 9

Extracellular to intracellular ratio of 2'FL at two time points. Strains expressing the indicated transporter are described in Example 6 and evaluated as described in Example 5. The ratios were calculated by normalizing the intracellular measurements to the amount of culture from which the cells were harvested. Ratios represent the average of biological triplicate experiments.

| Transporter; SEQ ID NO | 24 h ratio | 48 h ratio |
| --- | --- | --- |
| HGS71; 185 | 1.227194 | 3.743719 |
| HGS72; 186 | 2.461 | 6.47295 |
| HGS73; 167 | 1.506692 | 4.29191 |
| HGS74; 168 | 1.25056 | 4.956807 |
| Control (HS0012) | 1.454066 | 3.95871 |

Further analyses were carried out to test the ability of CDT2/HGS72 (SEQ ID NO: 186) to facilitate the export of 2'FL.

Inoculum Preparation

Frozen vials of HS0012 (control) and of HS0014 (CDT2) were thawed and transferred to 10 mL synthetic complete medium with 2% glucose in a 125 mL vented shake flask, and incubated at 30° C. and 300 rpm shaking for several hours. Two seed flasks were prepared using this culture in two 250 mL vented shake flasks with 40 mL of synthetic complete medium with 2% glucose for further growth at 30° C. and 300 rpm shaking. When the culture reached OD600 about 4, the two flask cultures were used to inoculate two 1 L fermenters. The synthetic complete medium composition is as follows: yeast nitrogen base without amino acids (Difco), 6.7 g/L; Synthetic Complete Drop-out:(Kaiser)-his-ura is (Formedium, England), 1.8 g/L; glucose was added to 2% (w/v) for the inoculum growth. The pH was adjusted to 5.2 with 20% potassium hydroxide and the medium filter sterilized through a 0.22µ filter.

Fermenter Preparation and Operation

Fermentations were carried out in 1 L Biostat B DCU3 fermenters (Sartorius, USA). Two fermenters were prepared with 500 mL 0.9% (w/v) NaCl solution and sterilized at 121'C for 30 minutes. After cooling, the salt solution was pushed out and 760 mL medium, which had been previously filter sterilized, was pumped into the fermenters. Synthetic complete medium with 2% glucose and 0.2 mL antifoam (DF204, Sigma, USA) was used in both fermentations. The temperature of the fermenter was maintained at 30° C., and pH controlled at 5.5 with 20% KOH throughout the entire fermentations. Aeration was controlled at 0.4 standard liters per minute, and dissolved oxygen controlled at 20% by agitation. Samples were drawn and analyzed for optical density at 600 nm and for glucose concentration by a YSI Select Biochemistry Analyzer (YSI, Inc., Yellow Springs, Ohio). Glucose excess was maintained throughout both fermentations, at 5-30 g/L, by manual additions of a 50% (w/w) solution. When the optical density was about 1.5, $CuSO_4$ to a final concentration of 100 µM and lactose to a final concentration of 5 g./L were added to each fermenter.

Figure 2A:
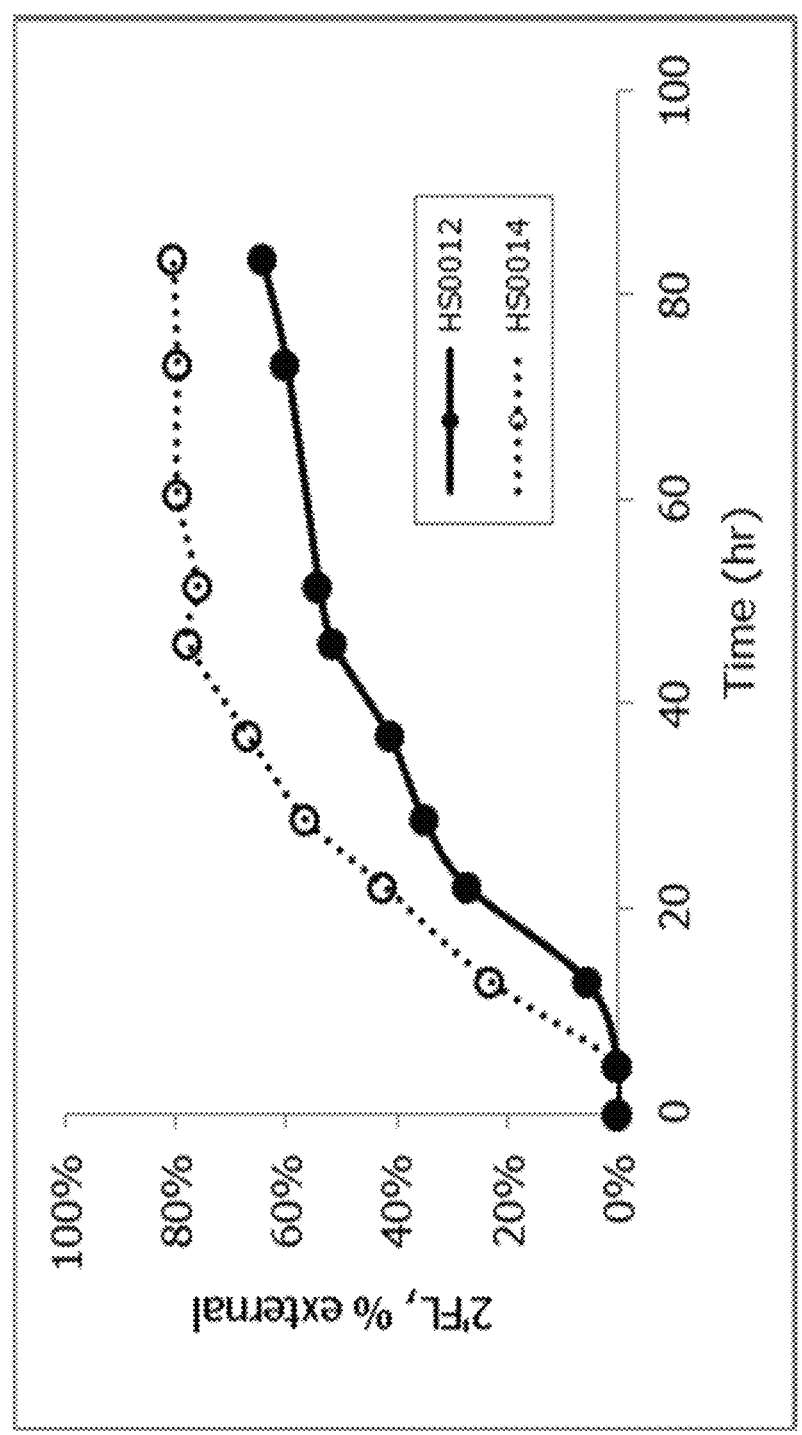
FIG. 2 (A-C) shows a comparison of 2'FL export from yeast cells heterologously expressing CDT2 versus control cells.
Figure 2B:
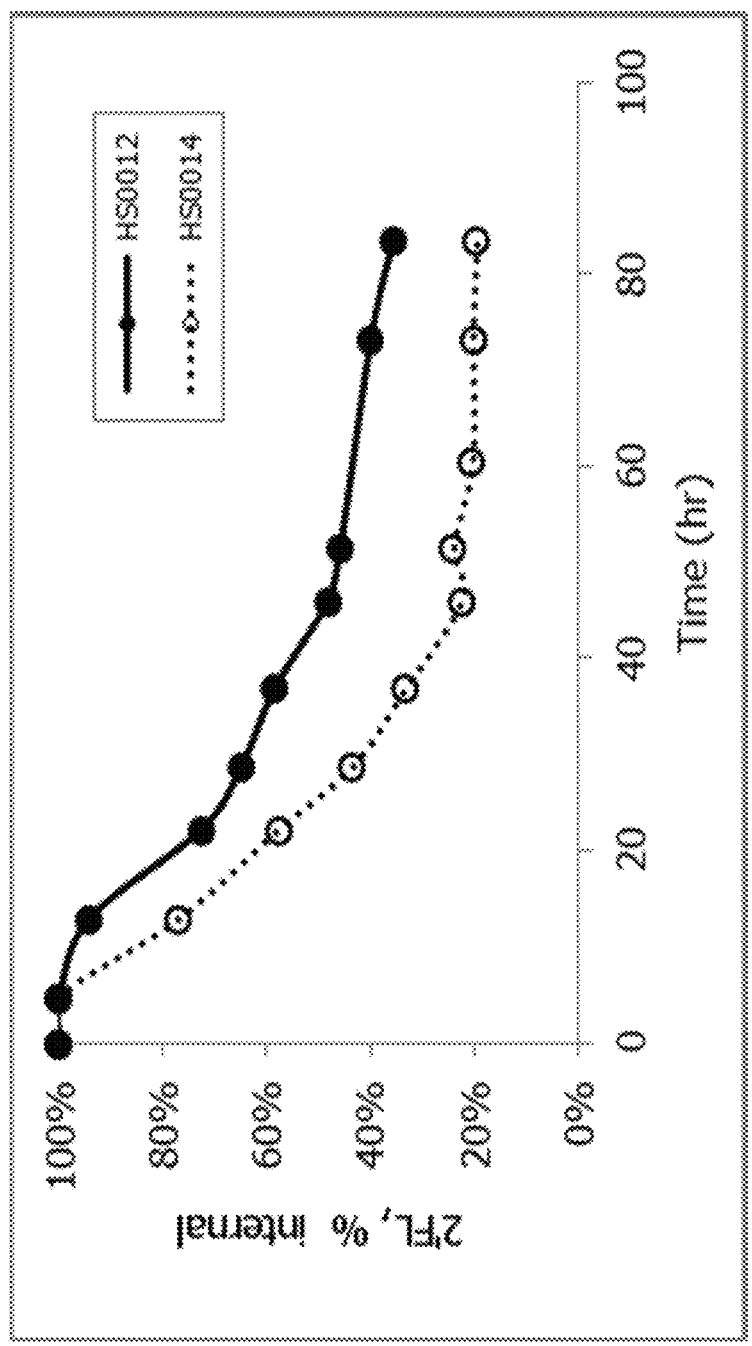
Figure 2C:
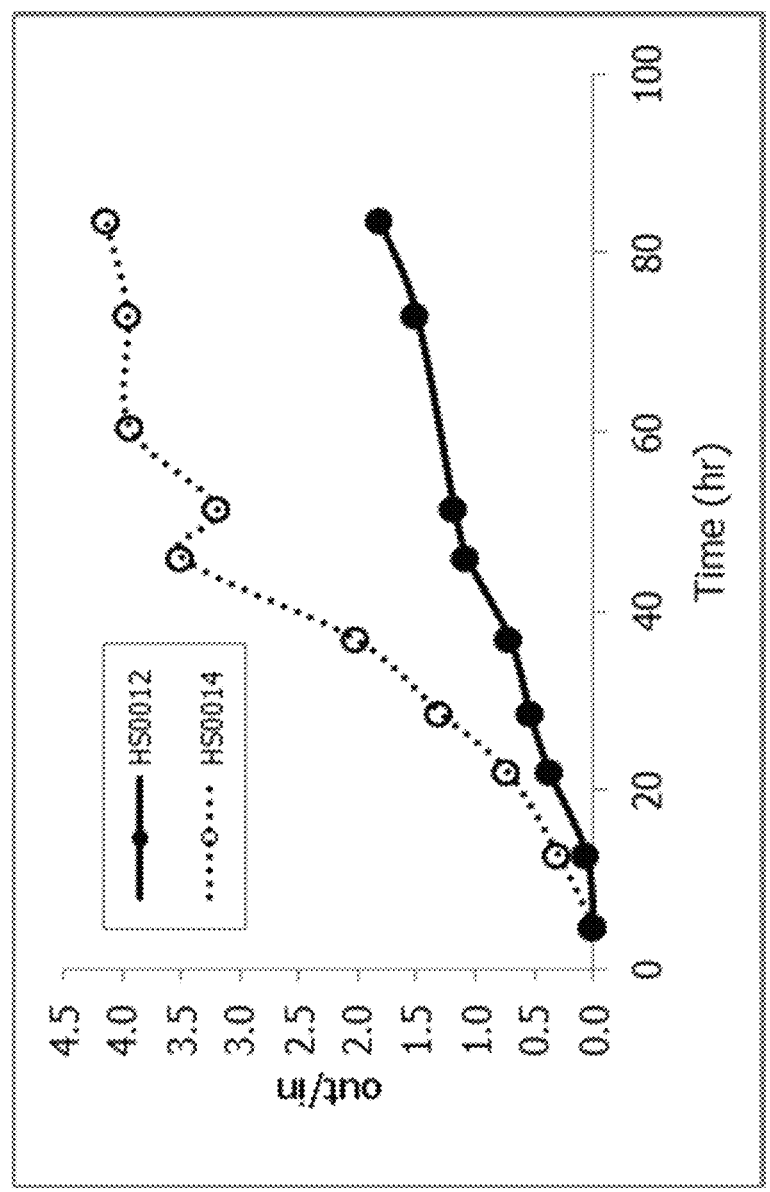

Samples from both fermenters were centrifuged to separate the biomass and cell pellets. Both fractions were stored at –80 C until analysis at the end of the experiment. Intracellular and extracellular 2'FL amounts from the cell pellets were determined as described in Example 5. The results in terms of extracellular and intracellular 2'FL percentages and the extracellular to intracellular 2'FL ratio are shown in FIGS. 2A-2C, respectively. As shown in FIGS. 2A-2C, in cells heterologously expressing CDT2, a greater amount (percentage and ratio) of the 2'FL was found in the extracellular fraction.

Example 8

Construction of a *Yarrowia lipolytica* Strain Producing 2'Fucosyllactose

This example describes the construction of strain HY006 [pYKH027], which is derived from *Yarrowia lipolytica* ATCC #20362 and produces 2'fucosyllactose.

Chromosomal Integration of Genes Encoding GDP-D-Mannose Dehydratase. GDP-6-Deoxy-4-Keto-Mannose Epimerase Reductase and Lactose Permease Strain HY004 was constructed by replacing the LIP7 locus on *Yarrowia* chromosome B with an expression cassette consisting of genes coding for GDP-D-mannose dehydratase (GMD), GDP-6-deoxy-4-keto-mannose epimerase reductase (GMER) and lactose permease (LAC12). GMD and GMER enable the strain to convert GDP-mannose, produced naturally by *Yarrowia*, to GDP-fucose. LAC12 enables the strain to take up lactose. GDP-fucose and lactose are the two precursors of 2'fucosyllactose.

The integration construct was assembled in the following series of steps. A synthetic nucleic acid fragment (HgB111) encoding the GDP-D-mannose dehydratase (GMD) from *Mortierella alpina* (Ren et al. Biochem. Biophys. Res. Commun. 391:1663-1669(2010)) was obtained from a commercial gene synthesis company (Integrated DNA Technologies, Inc., Coralville, Iowa)(SEQ ID No. 210). The coding region was codon-optimized for expression in *Yarrowia* as described in the general methods, based on the coding sequence of the GMD gene from *Mortierella alpina* (GEN- BANK accession no GU299800.1). An NcoI restriction site was incorporated over the ATG start codon of the GMD coding sequence and a NotI restriction site was incorporated downstream of the GMD stop codon. To permit incorporation of the NcoI site, a GCC codon (coding for alanine) was inserted immediately after the start codon. No other modifications were made to the amino acid sequence of the encoded polypeptide. The synthetic coding region was cloned into pCR-BluntII-TOPO (Zero blunt TOPO PCR Cloning Kit, Invitrogen) per the manufacturer's instructions and clones were sequenced. The NcoI-NotI fragment harboring the GMD coding sequence was excised from the TOPO plasmid and sub-cloned into the NcoI-NotI backbone of plasmid pZGD5T-CPP. pZGD5T-CPP is a derivative of plasmid pZGD5T-CPP, described in U.S. Pat. No. 8,470, 571, that has an additional PmeI site between the Pex16 terminator and the downstream PacI site. In the resulting plasmid, pYKH010, the GMD coding region was operably linked to the Yarrowia GPD promoter (U.S. Pat. No. 7,259, 255) and the terminator region from the Yarrowia Pex16 gene (Gen Bank Accession No. U75433). A ClaI-PmeI restriction fragment harboring the GPD-GMD-Pex16 expression cassette was excised from pYKH010.

A synthetic nucleic acid fragment (HgB110) encoding the GDP-6-deoxy-4-keto-mannose epimerase reductase (GMER) from Mortierella alpina (Ren et al. Biochem. Biophys. Res. Commun 391:1663-1669 (2010)) was obtained from a commercial gene synthesis company (Integrated DNA Technologies, Inc., Coralville, Iowa)(SEQ ID No. 211). The coding region was codon-optimized for expression in Yarrowia as described in the general methods, based on the coding sequence of the GMER gene from Mortierella alpina (GENBANK accession no GU299801.1). An NcoI restriction site was incorporated over the ATG start codon of the GMER coding sequence and a NotI restriction site was incorporated downstream of the GMER stop codon. To permit incorporation of the NcoI site, a GCC codon (coding for alanine) was inserted immediately after the start codon. No other modifications were made to the amino acid sequence of the encoded polypeptide. The synthetic gene was cloned into pCR-BluntII-TOPO (Zero blunt TOPO PCR Cloning Kit, Invitrogen) per the manufacturer's instructions and clones were sequenced. The NcoI-NotI fragment harboring the GMER coding sequence was excised from the TOPO plasmid and sub-cloned into an NcoI-NotI plasmid backbone consisting of an Ampicillin resistance gene for selection in E. coli, a URA3 gene for selection in Yarrowia (GENBANK Accession No. AJ306421), and regions of homology to sequences upstream and downstream of the Yarrowia lipase 7 gene (YAL10B11858g, GENBANK accession no. XM_500777). In the resulting plasmid, pYKH014, the GMER gene was operably linked to the Yarrowia FBA1 L promoter (U.S. Pat. No. 7,202,356) and the terminator region from the Yarrowia Pex20 gene (GENBANK Accession No. AF054613). A PmeI-SwaI restriction fragment harboring the FBA1L-GMER-Pex20 expression cassette was excised from pYKH014.

A synthetic nucleic acid fragment (HgB103) encoding the lactose permease (LAC12) from Kluyveromyces lactis was obtained from a commercial gene synthesis company (Integrated DNA Technologies, Inc., Coralville, Iowa)(SEQ ID No. 212). The gene was codon-optimized for expression in Yarrowia as described in the general methods, based on the coding sequence of K. lactis LAC12 (GENBANK accession no X06997.1). An NcoI restriction site was incorporated over the ATG start codon of the LAC12 coding sequence and a NotI restriction site was incorporated downstream of the LAC12 stop codon. None of the modifications in the codon-optimized sequence changed the amino acid sequence of the encoded protein. The synthetic coding region was cloned into pCR-BluntII-TOPO (Zero blunt TOPO PCR Cloning Kit, Invitrogen) per the manufacturer's instructions and clones were sequenced. The NcoI-NotI fragment harboring the LAC12 coding sequence was excised from the TOPO plasmid and sub-cloned into a Yarrowia expression plasmid backbone consisting of a Yarrowia lipolytica LEU2 gene (GENBANK Accession No. M37309) for selection in Yarrowia, Yarrowia lipolytica centromere and autonomously replicating sequence (ARS) 18 locus (GENBANK Accession No. M91600), E. coli f1 origin of replication, Ampicillin resistance gene for selection in E. coli, and ColE1 plasmid origin of replication. In the resulting plasmid, pYKH015, the LAC12 gene is operably linked to the Yarrowia EXP promoter (U.S. Pat. No. 8,685,682) and the terminator region from the Yarrowia Oct gene (GENBANK Accession No. X69988). A SwaI-BsiWI restriction fragment harboring the EXP-LAC12-Oct expression cassette was excised from pYKH015.

The integration plasmid pYKH019 was assembled via four-fragment ligation of (i) the ClaI-PmeI fragment excised from pYKH010, (ii) PmeI-SwaI fragment excised from pYKH014, (iii) the SwaI-BsiWI fragment excised from pYKH015, and (iv) a BsiWI-ClaI plasmid backbone consisting of an Ampicillin resistance gene for selection in E. coli, a URA3 gene for selection in Yarrowia (GENBANK Accession No. AJ306421), and regions of homology to sequences upstream and downstream of the Yarrowia lipase 7 gene (YALI0B11858g, GENBANK accession no. XM_500777). Proper construction of the plasmid was confirmed by sequencing using primers H536 (SEQ ID NO: 220), H537 (SEQ ID NO: 221), H538 (SEQ ID NO: 222), H539 (SEQ ID NO: 223), H540 (SEQ ID NO: 224), H541 (SEQ ID NO: 225), H117 (SEQ ID NO: 226), H118 (SEQ ID NO: 227), H121 (SEQ ID NO: 228), H122 (SEQ ID NO: 229), H123 (SEQ ID NO: 230) and H124 (SEQ ID NO: 231).

Digestion of plasmid pYKH019 with AscI yields a linear DNA fragment comprising the GPD-GMD-Pex16, FBA1L-GMER-Pex20 and EXP-LAC12-Oct expression cassettes together with a Yarrowia URA3 gene (GENBANK Accession No. AJ306421). These are flanked by regions of homology to sequences upstream (LIP7-5') and downstream (LIP7-3') of the Yarrowia LIP7 locus. To construct strain HY004, this AscI fragment was used to transform Yarrowia lipolytica strain Y2224 using standard transformation procedures (General Methods). Y2224 is an FOA resistant mutant as a result of an autonomous mutation of the URA3 gene of wild-type Yarrowia lipolytica strain ATCC #20362. Construction of Y2224 is described in Example 9 of U.S. Pat. No. 8,241,884. Transformants were obtained via selection on synthetic complete medium lacking uracil (SC-ura). Transformants grown on these plates were picked and re-streaked onto fresh SC-ura plates. Once grown, these transformants were screened for integration of the introduced DNA fragment into the LIP7 locus by colony PCR using Accustart II PCR Toughmix (according to the manufacturer's instructions) with primer pairs H125+H127 and H130+H126 (SEQ ID NOs: 232-235). Primers H125 and H127 (SEQ ID NOs: 232-233) amplify specifically over the junction between the integrated fragment and the region upstream of LIP7 on Yarrowia chromosome B. Primers H130 and H126 (SEQ ID NOs: 234-235) amplify specifically over the junction between the integrated fragment and the region downstream of LIP7 on Yarrowia chromosome B.

The removal of the wild-type LIP7 locus was confirmed by the absence of a 2.8 kb product generated by colony PCR using primers H125 and H126 (SEQ ID NOs: 232,234). One clone harboring the required integration at the LIP7 locus was designated HY004.

The URA3 gene introduced into strain HY004 was inactivated using the procedure disclosed in U.S. Provisional Appl. No. 62/036,652, Example 6, which was adapted as follows. Plasmid pRF203, which is the same as plasmid pRF84, except that it contains a hygromycin resistance cassette instead of a URA3 selectable marker was used, and the RGR sequence targeted the LEU2 locus rather than the CAN1 locus. Cells were transformed with pRF203, and transformants were selected on YPD+hygromycin. Clones with an inactivated URA3 gene were identified by replica plating hygromycin resistant colonies on synthetic complete medium plates containing uracil and synthetic complete medium plates lacking uracil. Ura-clones grow on medium containing uracil but do not grow on medium lacking uracil. One Ura-clone was designated HY006.

Construction of a Plasmid Encoding an α1,2-Fucosyltransferase

A synthetic nucleic acid fragment (HgB113) containing the coding region of the gene encoding the FutC α1,2-fucosyltransferase from *Helicobacter pylori* was obtained from a commercial gene synthesis company (Integrated DNA Technologies, Inc., Coralville, Iowa)(SEQ ID No. 213). The coding region was codon-optimized for expression in *Yarrowia* as described above, based on the coding sequence of the futC gene (GENBANK accession no EF452502). The synthetic coding region includes an NcoI restriction site over the ATG start codon of the futC coding sequence and a NotI restriction site downstream of the futC stop codon. The synthetic futC gene was cloned into pCR-BluntII-TOPO (Zero blunt TOPO PCR Cloning Kit, Invitrogen) per the manufacturer's instructions and clones were sequenced. One TOPO clone was used as a PCR template to amplify the futC coding region using primers H141 and H142 (SEQ ID NOs: 236-237). Primer H141 (SEQ ID NO: 236) adds an extension immediately upstream of the futC coding region that corresponds to the sequence at the 3 end of the SUMOstar tag from pYSUMOstar (Life Sensors, Malvern, Pa.). In a second PCR reaction, the SUMOstar tag was amplified from plasmid pY-SUMOstar (Life Sensors, Malvern, Pa.) using primers H137 and H138 (SEQ ID NOs: 238-239). The two PCR products were annealed and then amplified using primers H137 (SEQ ID NO: 238) and H142 (SEQ ID NO: 237). The resulting final PCR product was digested with NcoI and NotI and cloned into plasmid pZUFmEgD9ES (U.S. Pat. No. 8,703,473), pre-digested with the same enzymes, to replace the EgD9ES coding sequence. In the resulting plasmid, pYKH027, the FutC gene coding region was operably linked to the *Yarrowia lipolytica* FBAINm promoter (U.S. Pat. No. 7,202,356) and the terminator region of the *Yarrowia* Pex20 gene (GENBANK Accession No. AF054613). The sequence of pYKH027 was confirmed by sequencing using primers H101 and H102 (SEQ ID NOs: 240-241). Plasmid pYKH027 was transformed into *Yarrowia* strain HY006 as described in the General Methods. Transformants were selected by plating on synthetic complete medium plates lacking uracil. Two transformants were selected for further analysis and designated HY006 [pYKH027].

Example 9

Evaluation of 2'FL Production by *Yarrowia* Strain HY006 [pYKH027]

HY006 [pYKH027] was evaluated for production of 2'FL in shake flasks as follows. The two HY006 [pYKH027] clones were inoculated into synthetic complete medium lacking uracil and containing 2% glucose, then incubated for 20-24 hours at 30° C. with agitation at 220 rpm. Overnight cultures were sub-cultured into 10 mL of the same medium supplemented with 0.5% (w/v) lactose to a starting $OD_{600}$ of 0.4 (Beckman BioPhotometer, Hamburg. Germany) and cultures were incubated at 30° C. with agitation at 220 rpm. To evaluate 2'FL production under glucose-limited conditions, overnight cultures were grown as described above, then sub-cultured to a starting $OD_{600}$ of 0.4 into 10 mL synthetic complete medium supplemented with 0.5% (w/v) lactose but lacking glucose. A single glucose FeedBead (Kuhner Shaker, catalog number SMFB63319) was added to each culture and cultures were incubated at 30° C. with agitation at 220 rpm. At approximately 12-hour intervals, an additional feed bead was added to each culture.

At various time-points, culture samples (1.5-2 ml) were centrifuged to separate cells from medium. The cell pellets were frozen at −80° C. Culture supernatants were filtered using 0.2 micron AcroPrep Advance 96 filter plates (Pall, Port Washington, N.Y.) and stored at −20° C. Intracellular and extracellular concentrations of 2'FL were measured as described in Example 5. Intracellular and extracellular concentrations of 2'FL for strain HY006[pYKH027] grown under batch glucose and glucose-limited (feed bead) conditions are provided in Table 10.

TABLE 10

Intracellular 2'FL (mM) and Extracellular 2'FL (uM) measured for strain HY006[pYKH027], described in Example 8. Data represent averages from biological triplicate experiments, and are shown ± one standard deviation.

| | Glucose feed | Intracellular 2'FL (mM) | | Extracellular 2'FL (uM) | |
|---|---|---|---|---|---|
| | | 24 h | 48 h | 24 h | 48 h |
| Test 1 | Batch | 14.4 ± 2.1 | 8.7 ± 1.3 | N.D. | 416.7 ± 67.9 |
| | Feed bead | 42.8 ± 6.1 | 32.7 ± 2.8 | N.D. | 319.6 ± 40.1 |
| Test 2 | Batch | 14.5 ± 2.0 | 13.7 ± 1.0 | 151.9 ± 5.0 | 203.5 ± 11.0 |
| | Feed bead | 22.9 ± 1.5 | 37.0 ± 2.3 | 103.0 ± 7.7 | 349.0 ± 16.5 |

(N.D. = not done)

Example 10

Evaluation of Transporter Candidates in 2'FL-Producing *Yarrowia* Strains

Construction of Transporter Expression Plasmids for Expression of Transporter Candidates in *Yarrowia* Strains Plasmid pYKH033 (seq ID no. 214) was used to clone transporter candidates for expression in *Yarrowia*. pYKH033 includes the following functional components: (i) A synthetic LAC4 gene coding region (coding for beta-galactosidase from *K. lactis*) operably linked to the *Yarrowia* FBA1L promoter (U.S. Pat. No. 7,202,356) and the terminator region of the *Yarrowia* Pex20 gene (GENBANK Accession No. AF054613), whereby the NcoI-NotI fragment harboring the LAC4 coding region can be excised and replaced with coding regions for transporters as described below: (ii) ColE1 plasmid origin of replication: (iii) Ampicillin resistance gene for selection in *E. coli*; (iv) *E. coli* f1 origin of replication; (v) *Yarrowia lipolytica* centromere and autonomously replicating sequence (ARS) 18 locus (GENBANK Accession No. M91600); and (vi) *Yarrowia lipolytica* LEU2 gene (GENBANK Accession No. M37309) for selection in *Yarrowia*.

Eighteen transporter candidates were identified by bioinformatics, as described in Examples 1-3, to represent plant and fungal Sweet homologs as well as a subset of MFS family transporters (homologs of sugar-phosphate efflux antiporter SetA and a yeast maltotriose symporter MAL21). DNA sequences encoding the transporters were codon optimized for expression in *Yarrowia* as described in the General Methods. Synthetic gene fragments encoding each transporter were synthesized by a commercial gene synthesis company (GenScript, Piscataway, N.J.). (SEQ ID NOs: 188, 191-206, 209, Table 12). The pYKH033 vector, described above, was sent to GenScript (Piscataway, N.J.) for custom gene cloning of each candidate transporter between the NcoI and NotI sites (i.e. replacing the LAC4 open reading frame). In each of the resulting transporter expression plasmids, the transporter coding sequence is operably linked to the FBA1 L promoter (U.S. Pat. No. 7,202,356) and the terminator region of the *Yarrowia* Pex20 gene (GENBANK Accession No. AF054613).

A control plasmid was constructed by cloning an NcoI-NotI stuffer fragment excised from plasmid pFBAIN-MOD-1 (described in U.S. Pat. No. 8,822,185) between the NcoI and NotI sites in plasmid pYKH033, replacing the LAC4 gene. The resulting control plasmid, pYKH056, lacks a cloned transporter gene.

Expression of Transporter Candidates in 2'FL-Producing *Yarrowia* Strains

To introduce transporter expression plasmids harboring a LEU2 marker, the LEU2 gene was inactivated in *Yarrowia* strain HY006 using the procedure disclosed in U.S. Provisional Appl. No. 62/036,652. Clones with an inactivated LEU2 gene were identified by replica plating on synthetic complete medium plates containing leucine and synthetic complete medium plates lacking leucine. Leu-clones grew on medium containing leucine but did not grow on medium lacking leucine. From several Leu-clones, the LEU2 locus was amplified by colony PCR using primers R204 (SEQ ID NO: 244) and R205 (SEQ ID NO: 245) and sequenced using primer H163 (SEQ ID NO: 246) to confirm the presence of an inactivating mutation in the LEU2 gene. One Leu-clone was designated HY009.

HY009 was transformed with the fucosyltransferase expression plasmid pYKH027 as described in the General Methods. Transformants were selected on synthetic complete medium plates lacking uracil and supplemented with approximately 380 mg/L leucine. One clone was selected and evaluated for production of 2'FL under batch glucose and glucose-limited conditions as described for HY006 [pYKH027] in Example 9. Intracellular and extracellular concentrations of 2'FL for strain HY009[pYKH027] are provided in Table 11.

TABLE 11

Intracellular 2'FL (mM) and Extracellular 2'FL (uM) measured for strain and HY009[pYKH027], described in Example 10. Data represent averages from biological triplicate experiments, and are shown ± one standard deviation.

| Glucose feed | Intracellular 2'FL (mM) | | Extracellular 2'FL (uM) | |
| --- | --- | --- | --- | --- |
| | 48 h | 72 h | 48 h | 72 h |
| Batch | 13.2 ± 0.4 | 18.1 ± 2.3 | N.D. | 454.7 ± 19.2 |
| Feed bead | 61.0 ± 4.2 | 59.9 ± 3.4 | N.D. | 225.5 ± 5.3 |

(N.D. = not done)

HY009 [pYKH027] was then transformed with each of the 18 transporter expression plasmids (pYKH033 derivatives) as described in the General Methods. HY009 [pYKH027] was also transformed with the control plasmid pYKH056 to construct a control strain lacking a heterologous transporter. Transformants were selected on synthetic complete medium plates lacking both uracil and leucine. Three clones from each transformation were streaked onto the same medium and then evaluated for 2'FL production and export as follows. Clones were inoculated into synthetic complete medium lacking both uracil and leucine and containing 2% (w/v) glucose, and incubated for 20-24 h at 30° C. with agitation at 220 rpm. Overnight cultures were sub-cultured to a starting $OD_{600}$ of 0.4 (Biophotometer, Eppendorf) in 10 mL of the same medium supplemented with 0.5% (w/v) lactose. Cultures were incubated at 30° C. with agitation at 220 rpm. 24 and 48 h after sub-culturing, 2 ml culture samples were centrifuged to separate cells from medium. The cell pellets were frozen at −80° C. Culture supernatants are filtered using 0.2 micron AcroPrep Advance 96 filter plates (Pall, Port Washington, N.Y.) and stored at −20° C. Intracellular and extracellular concentrations of 2'FL were measured as described in Example 5. The average ratios of external to internal 2'FL for strains expressing each transporter, as compared to cells harboring the control plasmid pYKH056, are reported in Table 12.

TABLE 12

Extracellular to intracellular ratio of 2'FL for *Yarrowia* strains expressing the indicated transporters, described in Example 10. Intracellular and extracellular concentrations of 2'FL were measured as described in Example 5. The ratios were calculated by normalizing the intracellular measurement to the amount of culture from which the cells were harvested. Ratios represent the average extracellular to intracellular ratios from biological triplicate experiments. The control strain lacks a heterologous transporter.

| Transporter; SEQ ID NO | 24 h ratio | 48 h ratio |
| --- | --- | --- |
| HgS118; 202 | 0.463 | 2.387 |
| HgS119; 197 | 0.597 | 2.599 |
| HgS120; 195 | 0.780 | 1.684 |
| HgS121; 200 | 0.593 | 2.034 |
| HgS122; 196 | 0.590 | 2.1634 |
| HgS123; 198 | 0.822 | 1.9274 |
| HgS124; 201 | 0.762 | 1.7524 |

TABLE 12-continued

Extracellular to intracellular ratio of 2'FL for *Yarrowia* strains expressing the indicated transporters, described in Example 10. Intracellular and extracellular concentrations of 2'FL were measured as described in Example 5. The ratios were calculated by normalizing the intracellular measurement to the amount of culture from which the cells were harvested. Ratios represent the average extracellular to intracellular ratios from biological triplicate experiments. The control strain lacks a heterologous transporter.

| Transporter; SEQ ID NO | 24 h ratio | 48 h ratio |
|---|---|---|
| HgS125; 199 | 0.452 | 1.9964 |
| HgS126; 191 | 0.557 | 1.306 |
| HgS127; 192 | 0.744 | 1.776 |
| HgS128; 193 | 0.597 | 1.671 |
| HgS129; 194 | 0.778 | 1.842 |
| HgS130; 204 | 0.870 | 2.231 |
| HgS131; 203 | 0.611 | 2.273 |
| HgS132; 188 | 0.648 | 2.200 |
| HgS133; 206 | 0.424 | 2.168 |
| HgS134; 205 | 0.655 | 1.745 |
| HgS135; 209 | 0.754 | 2.117 |
| control | 0.511 | 1.957 |

A subset of these transporters were evaluated under glucose-limited conditions, which had been found to increase intracellular 2'FL production (Tables 10 and 11). For glucose-limitation experiments, cultures were grown essentially as described in the previous paragraph, except cells were sub-cultured into media lacking glucose. A single glucose FeedBead was added to each flask at 12 hour intervals. Samples were taken after 72 h incubation, and intracellular and extracellular concentrations of 2'FL were measured as described in Example 5. The average ratios of external to internal 2'FL for strains expressing transporters, as well as cells harboring the control plasmid pYKH056, are reported in Table 13. For HgS132, the experiment was repeated, except that feed beads were added either at 12 hour or 24 hour intervals after sub-culturing into media lacking glucose, and intracellular and extracellular 2'FL levels were measured after 24h, 48 h or 72 h growth. The results of this repeat experiment are shown in Table 14

TABLE 13

Extracellular to intracellular ratio of 2'FL for *Yarrowia* strains expressing the indicated transporters, described in Example 10, after growth in batch glucose or under glucose-limited conditions. Intracellular and extracellular concentrations of 2'FL were measured as described in Example 5. The ratios were calculated by normalizing the intracellular measurement to the amount of culture from which the cells were harvested. Ratios represent the average extracellular to intracellular ratios from biological triplicate experiments and are shown ± one standard deviation. The control strain lacks a heterologous transporter.

| Transporter; SEQ ID NO | Batch glucose 72 h ratio | Feed beads 72 h ratio |
|---|---|---|
| control | 4.489 ± 0.65 | 1.956 ± 0.37 |
| HgS132; 188 | 5.176 ± 1.60 | 3.636 ± 0.74 |
| HgS131; 203 | 6.616 ± 3.41 | 2.614 ± 0.68 |

TABLE 14

Extracellular to intracellular ratio of 2'FL for a *Yarrowia* strain expressing the HgS132 transporter candidate at three time points under different glucose feeding regimens. Intracellular and extracellular concentrations of 2'FL were measured as describe in Example 5. The ratios were calculated by normalizing the intracellular measurement to the amount of culture from which the cells were harvested. Ratios represent the average extracellular to intracellular ratios from three to six biological replicate experiments and are shown ± one standard deviation. The control strain lacks a heterologous transporter.

| Transporter; SEQ ID NO | Feed bead frequence | 24 h ratio | 48 h ratio | 72 h ratio |
|---|---|---|---|---|
| control | Every 12 h | 0.329 ± 0.04 | 0.600 ± 0.03 | 0.616 ± 0.11 |
| HgS132; 188 | Every 12 h | 0.225 ± 0.03 | 0.957 ± 0.12 | 0.768 ± 0.11 |
| control | Every 24 h | 0.292 ± 0.006 | 0.529 ± 0.07 | 0.864 ± 0.03 |
| HgS132; 188 | Every 24 h | 0.214 ± 0.038 | 0.487 ± 0.04 | 1.400 ± 0.10 |

Example 11

Evaluation of Additional Transporter Candidates in *Yarrowia*

Four additional transporter candidates were selected by bioinformatics that represent cellodextrin transporters (MFS family, HgS136 and HgS137) and multidrug efflux pumps (RND family. HgS138 and HgS139). DNA sequences encoding the transporters were codon optimized and obtained from a commercial gene synthesis company (Gen-Script, Piscataway, N.J.). (SEQ ID NOs: 189-190, 207-208, Tables 15-16). The pYKH033 vector, described above, was sent to GenScript (Piscataway, N.J.) for custom gene cloning of each candidate transporter at the NcoI/NotI sites (i.e. replacing the LAC4 open reading frame).

Strains were constructed as described above in Example 10, grown under batch glucose and glucose-limited conditions as described in Example 10, and were subsequently evaluated for 2'FL production as described above in Example 5. Extracellular to intracellular 2'FL ratios for the strains are provided in Table 15 and Table 16.

TABLE 15

Extracellular to intracellular ratio of 2'FL for *Yarrowia* strains expressing the indicated transporters, described in Example 11. Strains were grown under batch glucose or glucose-limited conditions as described in Example 10, and intracellular and extracellular concentrations of 2'FL were measured as describe in Example 5. The ratios were calculated by normalizing the intracellular measurement to the amount of culture from which the cells were harvested. Ratios represent the average average extracellular to intracellular ratios from biological triplicate experiments and are shown ± one standard deviation. The control strain lacks a heterologous transporter.

| Transporter; SEQ ID NO | Glucose feeding | 24 h ratio | 48 h ratio | 72 h ratio |
|---|---|---|---|---|
| control | batch | 0.515 ± 0.05 | 0.879 ± 0.22 | 1.294 ± 0.51 |
| HgS138; 189 | batch | 0.428 ± 0.02 | 0.504 ± 0.06 | 0.719 ± 0.12 |
| HgS139; 190 | batch | 0.489 ± 0.06 | 0.495 ± 0.10 | 0.846 ± 0.05 |

TABLE 15-continued

Extracellular to intracellular ratio of 2'FL for *Yarrowia* strains expressing the indicated transporters, described in Example 11. Strains were grown under batch glucose or glucose-limited conditions as described in Example 10, and intracellular and extracellular concentrations of 2'FL were measured as describe in Example 5. The ratios were calculated by normalizing the intracellular measurement to the amount of culture from which the cells were harvested. Ratios represent the average average extracellular to intracellular ratios from biological triplicate experiments and are shown ± one standard deviation. The control strain lacks a heterologous transporter.

| Transporter; SEQ ID NO | Glucose feeding | 24 h ratio | 48 h ratio | 72 h ratio |
|---|---|---|---|---|
| control | Feed beads | 0.703 ± 0.05 | 0.378 ± 0.05 | 0.894 ± 0.11 |
| HgS138; 189 | Feed beads | 0.828 ± 0.10 | 0.380 ± 0.03 | 1.050 ± 0.15 |
| HgS139; 190 | Feed beads | 0.857 ± 0.15 | 0.428 ± 0.03 | 0.990 ± 0.17 |

TABLE 16

Extracellular to intracellular ratio of 2'FL for *Yarrowia* strains expressing the indicated transporters, described in Example 11. Strains were grown under batch glucose or glucose-limited conditions as described in Example 10, and intracellular and extracellular concentrations of 2'FL were measured as described in Example 5. The ratios were calculated by normalizing the intracellular measurement to the amount of culture from which the cells were harvested. Ratios represent the average extracellular to intracellular ratios from biological triplicate experiments and are shown ± one standard deviation. The control strain lacks a heterologous transporter.

| Transporter; SEQ ID NO | Glucose feeding | 24 h ratio | 48 h ratio | 72 h ratio |
|---|---|---|---|---|
| control | batch | 0.763 ± 0.14 | 1.133 ± 0.34 | 2.581 ± 0.71 |
| HgS136; 207 | batch | 0.506 ± 0.02 | 0.915 ± 0.16 | 3.025 ± 0.11 |
| HgS137; 208 | batch | 0.550 ± 0.01 | 1.029 ± 0.10 | 3.458 ± 0.20 |
| control | Feed beads | 0.349 ± 0.06 | 0.851 ± 0.13 | 2.8145 ± 0.33 |
| HgS136; 207 | Feed beads | 0.378 ± 0.05 | 0.881 ± 0.13 | 3.807 ± 0.55 |
| HgS137; 208 | Feed beads | 0.408 ± 0.06 | 0.934 ± 0.08 | 3.679 ± 0.48 |

Example 12

Construction of a 2'FL Producing *Yarrowia* Strain with the Full Pathway to 2'FL on the Chromosome This example describes the construction of *Yarrowia* strain HY015, in which genes encoding a GDP-D-mannose dehydratase, GDP-6-deoxy-4-keto-mannose epimerase reductase, lactose permease and α1,2-fucosyltransferase for production of 2'FL are all integrated into the chromosome. This enabled screening of transporters using a single-plasmid expression system, described in Example 13.

Strain HY015 was constructed by replacing the POX2 locus on chromosome F of *Yarrowia* strain HY006 (described in Example 8) with a gene cassette for expression of the FutC α1,2-fucosyltransferase from *Helicobacter pylori*. A PmeI-BsiWi fragment harboring the FutC expression cassette was excised from plasmid pYKH027, described in Example 8, and sub-cloned into a PmeI-BsiWI backbone consisting of an ampicillin resistance gene for selection in *E. coli*, a URA3 gene for selection in *Yarrowia* (GENBANK Accession No. AJ306421), and regions of homology to sequences upstream and downstream of the *Yarrowia* POX2 gene (YALI0F10857g, GENBANK accession no. XP_505264.1). In the resulting plasmid, pYKH036 (SEQ ID NO.: 215), the SUMOstar-tagged FutC gene coding region was operably linked to the *Yarrowia lipolytica* FBAINm promoter (U.S. Pat. No. 7,202,356) and the terminator region of the *Yarrowia* Pex20 gene (GENBANK Accession No. AF054613). Digestion of pYKH036 with AscI and SphI yielded a linear DNA fragment comprising the FBAINm-SUMOstarFutC-Pex20 expression cassette together with a *Yarrowia* URA3 gene (GenBank Accession No. AJ306421). These are flanked by regions of homology to sequences upstream (POX2-5') and downstream (POX2-3') of the *Yarrowia* POX2 locus. To construct strain HY011, this AscI-SphI fragment was used to transform *Yarrowia* strain HY006, described in Example 8, using standard transformation procedures (General Methods). Transformants were obtained via selection on synthetic complete medium lacking uracil (SC-ura). Transformants grown on these plates were picked and re-streaked onto fresh SC-ura plates. Once grown, these transformants were screened for integration of the introduced DNA fragment into the POX2 locus by colony PCR using Accustart II PCR Toughmix (according to the manufacturer's instructions) with primer pairs H542+H543 and H544+H545 (SEQ ID NOs: 216-219). Primers H542 and H543 (SEQ ID NOs: 216-217) amplify specifically over the junction between the integrated fragment and the region upstream of POX2 on *Yarrowia* chromosome F. Primers H544 and H545 (SEQ ID NOs: 218-219) amplify specifically over the junction between the integrated fragment and the region downstream of POX2 on *Yarrowia* chromosome F. The removal of the wild-type POX2 locus was confirmed by the absence of a PCR product generated by colony PCR using primers H534 and H535 (SEQ ID NOs: 242-243), which anneal to the wild-type POX2 gene. One clone harboring the required integration at the POX2 locus was designated HY011.

Strain HY011 was evaluated for production of 2'FL in shake flasks as follows. Cells were grown under batch glucose or glucose-limited conditions (on FeedBeads) as described for strain HY006[pYKH027] in Example 9. Samples were taken after 24 and 48 h and intracellular and extracellular concentrations of 2'FL were measured as described in Example 5. Intracellular and extracellular concentrations of 2'FL for strain HY011 grown under batch glucose and glucose-limited conditions are provided in Table 17. In parallel, strain HY006[pYKH027] was grown and evaluated for intracellular and extracellular 2'FL concentrations.

TABLE 17

Intracellular 2'FL (mM) measured for strain HY011, described in Example 12. Data represent averages from four biological replicate experiments, and are shown ± one standard deviation.

| | Batch glucose | | Feed beads | |
|---|---|---|---|---|
| | 24 h | 48 h | 24 h | 48 h |
| HY011 | 12.5 ± 1.0 | 10.2 ± 0.03 | 38.0 ± 2.1 | 30.8 ± 1.6 |
| HY006 [pYKH027] | 14.4 ± 2.1 | 8.7 ± 1.3 | 42.8 ± 6.1 | 32.7 ± 2.8 |

TABLE 18

Extracellular 2'FL (uM) measured for strain HY011, described in Example 12. Data represent averages from four biological replicate experiments, and are shown ± one standard deviation.

|  | Batch glucose | | Feed Beads | |
| --- | --- | --- | --- | --- |
|  | 24 h | 48 h | 24 h | 48 h |
| HY011 | N.D. | 530.7 ± 34.4 | N.D. | 280.7 ± 12.1 |
| HY006 [pYKH027] | N.D. | 416.7 ± 67.9 | N.D | 319.6 ± 40.4 |

The URA3 gene introduced into strain HY011 was inactivated using the procedure disclosed in U.S. Provisional Appl. No. 62/036,652, Example 6, which was adapted as described in Example 8. One Ura-clone was designated HY015.

Example 13

Evaluation of Transporter Candidates in 2'FL-Producing Yarrowia Strain HY015 Using a Single-Plasmid System Two transporter candidates, SetA (HgS132) and CDT2 (HgS137), were cloned under the control of the strong FBAINm promoter (described in U.S. Pat. No. 7,202,356) and evaluated for 2'FL export in strain HY015. The SetA expression plasmid pYKH069 was constructed by excising the NcoI-NotI fragment harboring the SetA coding region (SEQ ID NO 188) from the pYKH033 derivative described in Example 10. This NcoI-NotI fragment was sub-cloned into plasmid pZUFmEgD9ES (U.S. Pat. No. 8,703,473), pre-digested with the same enzymes, to replace the EgD9ES coding sequence. In the resulting plasmid, pYKH069, the SetA coding region was operably linked to the *Yarrowia lipolytica* FBAINm promoter (U.S. Pat. No. 7,202,356) and the terminator region of the *Yarrowia* Pex20 gene (GEN-BANK Accession No. AF054613). The CDT2 expression plasmid pYKH082 was constructed by excising the NcoI-NotI fragment harboring the CDT2 coding region (SEQ ID NO 208) from the pYKH033 derivative described in Example 10. This NcoI-NotI fragment was sub-cloned into plasmid pZUFmEgD9ES (U.S. Pat. No. 8,703,473), pre-digested with the same enzymes, to replace the EgD9ES coding sequence. In the resulting plasmid. pYKH082, the CDT2 coding region was operably linked to the *Yarrowia lipolytica* FBAINm promoter (U.S. Pat. No. 7,202,356) and the terminator region of the *Yarrowia* Pex20 gene (GEN-BANK Accession No. AF054613).

pYKH069 and pYKH082 were transformed into strain HY015, described in Example 12, as described in the General Methods. Transformants were selected on synthetic complete medium plates lacking uracil. Three clones were selected and evaluated for production of 2'FL under batch glucose and glucose-limited conditions as described for HY006 [pYKH027] in Example 9. Samples were taken after 24 h, 48 h and 72 h and evaluated for 2'FL production as described above in Example 5. Extracellular to intracellular 2'FL ratios for the strains are provided in Table 19 and Table 20.

TABLE 19

Extracellular to intracellular ratio of 2'FL produced by *Yarrowia* strains expressing SetA using the single-plasmid system. Strains were constructed and grown as described in Example 13, and extracellular and intracellular 2'FL levels were measured as described in Example 5. The ratios were calculated by normalizing the intracellular measurement to the amount of culture from which the cells were harvested. Ratios represent the average extracellular to intracellular ratios from biological triplicate experiments and are shown ± one standard deviation. The control strain lacks a heterologous transporter.

| Transporter; SEQ ID NO | Glucose feeding | 24 h ratio | 48 h ratio | 72 h ratio |
| --- | --- | --- | --- | --- |
| control | Batch | 0.194 ± 0.03 | 0.180 ± 0.01 | 0.219 ± 0.01 |
| HgS132; 188 | Batch | 0.198 ± 0.02 | 0.223 ± 0.04 | 0.272 ± 0.03 |
| control | Feed beads | 0.534 ± 0.09 | 0.222 ± 0.04 | 0.226 ± 0.05 |
| HgS132; 188 | Feed beads | 0.477 ± 0.05 | 0.287 ± 0.04 | 0.412 ± 0.02 |

TABLE 20

Extracellular to intracellular ratio of 2'FL produced by *Yarrowia* strains expressing CDT2 using the single-plasmid system. Strains were constructed and grown as described in Example 13, and extracellular and intracellular 2'FL levels were measured as described in Example 5. The ratios were calculated by normalizing the intracellular measurement to the amount of culture from which the cells were harvested. Ratios represent the average extracellular to intracellular ratios from biological triplicate experiments and are shown ± one standard deviation. The control strain lacks a heterologous transporter.

| Transporter; SEQ ID NO | Glucose feeding | 24 h ratio | 48 h ratio | 72 h ratio |
| --- | --- | --- | --- | --- |
| control | Batch | 1.27 ± 0.11 | 7.20 ± 1.21 | 11.65 ± 0.92 |
| HgS137; 208 | Batch | 1.31 ± 0.09 | 5.31 ± 1.06 | 9.14 ± 0.80 |
| control | Feed beads | 0.41 ± 0.06 | 0.72 ± 0.03 | 4.81 ± 1.52 |
| HgS137; 208 | Feed beads | 0.61 ± 0.04 | 1.15 ± 0.06 | 7.60 ± 0.26 |

Example 14

Construction of Strain HS0007 (*Saccharomyces cerevisiae*)

This example describes strain HS0007, which builds upon strain HS0003 described in Example 4 above. HS0007 carries two plasmids-one expressing the *E. coli* GMD and GMER enzymes and the other expressing SUMO-tagged FutC_Hp. In this case the selectable marker for the FutC_Hp plasmid was changed from TRP1 to URA3, as described below.

An additional plasmid expressing GMD and GMER enzymes from *Arabidopsis thaliana* was also prepared, essentially as described above in Example 4 for pRS413::GMD-GMER_Ec. The new gene sequences (SEQ ID NOs. 247 and 248) were obtained from IDT, cloned and sequenced as described above for the *E. coli* GMD/GMER pair and then transferred to the yeast expression vector using the same gap repair cloning strategy. The primers used to amplify the genes for this last step were H11 and H12 (GMD_At) and H13 and H14 (GMER_At), corresponding to SEQ ID NOs. 249-252. The host strain for the gap repair cloning was PNY1500 (above). Four clones identified by PCR were subsequently sequenced. One plasmid was designated pRS413::GMD-GMER_At. This plasmid was recovered from yeast cells (Zymo Prep™ Yeast Plasmid Miniprep II kit, Zymo Research, Cat. No. D2004) and propagated in *E. coli* Stbl3 cells (Invitrogen, Cat. No. C7373-03, transformed via the manufacturer's protocol). Plasmid DNA prepared from the transformed Stbl3 cells was used to transform yeast strain HS0003 (Example 1). Transformants were selected by plating the transformation mixture on synthetic complete medium without histidine. One clone was designated HS0004.

The pY-SUMOstar::futC_Hp plasmid described in Example 1 was further modified to change the selectable marker from TRP1 to URA3. This was done by digesting the plasmid with Bsu36I and transforming the linear DNA fragment into HS0004 (above) along with a linear DNA fragment containing the URA3 selectable marker as amplified from pRS426 (ATCC #77107) using primers H305 and H306 (SEQ ID NOs. 253 and 254).

Successfully transformed colonies were selected for on synthetic complete medium without uracil and histidine. Colonies were screened by PCR using primers H291 and H292 (SEQ ID NOs. 255 and 256). Three of these transformants were evaluated for production of 2'FL, as described in Example 5. The pY-SUMOstar-URA::futC_Hp plasmid was recovered from one clone (designated HS0006) using the Zymo Prep™ kit. Plasmids were transferred to *E. coli* Stbl3 cells (Invitrogen, catalog number C7373-03) per the manufacturer's instructions. Plasmids prepared from Stbl3 cells were used to transform HS0003 along with pRS413::GMD-GMER_Ec (strain and plasmid described above). Transformants again were evaluated as described in Example 5 and one 2'FL-producing clone was designated HS0007. Negative control strains were also prepared by transforming strain HS0003 with only the fucosyltransferase plasmid (plus empty plasmid pRS413) and transforming strain HS0004 with an empty URA3 selectable plasmid (pHR81, ATCC #87541).

Example 15

Construction of a 2'FL Producing *Yarrowia* Strain with Two Copies of Each 2'FL Pathway Gene on the Chromosome This example describes the construction of *Yarrowia* strain HY028, which is a derivative of strain HY015, described in Example 12 above, into which an additional copy of each of the genes encoding GDP-D-mannose dehydratase, GDP-6-deoxy-4-keto-mannose epimerase reductase, lactose permease and a1,2-fucosyltransferase is integrated into the chromosome. The resulting strain contains two copies each of GMD, GMER, LAC12 and FutC.

To permit integration of a single DNA fragment harboring an additional copy each of LAC12, GMD (*M. alpina*), GMER (*M. alpina*) and SUMOstar-FutC_Hp into *Yarrowia*, the integration plasmid pYKH101 was constructed as follows. To assemble a SED1-SUMOstarFutC_Hp-Pex20 expression cassette, the SED1 promoter was amplified from genomic DNA of *Y. lipolytica* strain ATCC20362 using primer H164 (SEQ ID NO:257) that incorporates a PmeI site upstream of the SED1 promoter and primer H165 (SEQ ID NO:258) that incorporates a NcoI site downstream of the promoter. The resulting PCR product was digested with PmeI and NcoI and cloned between the PmeI and NcoI sites in plasmid pYKH027, replacing the FBAINm promoter. The resulting plasmid was designated pYKH046. To construct plasmid pYKH101, the SED1-SUMOstarFutC_Hp-Pex20 expression cassette was amplified from plasmid pYKH046 by PCR using primers H742 (SEQ ID NO:259) and H743 (SEQ ID NO:260) than introduce an EcoRI site upstream of the SED1 promoter and a PacI site downstream of the Pex20 terminator. The resulting PCR product was digested with EcoRI and PacI and cloned into plasmid pYKH019 that had been linearized by digestion with the same enzymes. Correct construction of the resulting plasmid, pYKH101, was confirmed by sequencing.

Digestion of pYKH101 with AscI yielded a linear DNA fragment comprising expression cassettes for LAC12, GMD, GMER and FutC together with a *Yarrowia* URA3 gene. These are flanked by regions of homology to sequences upstream and downstream of the *Yarrowia* LIP7 locus. This AscI fragment was gel purified away from the plasmid backbone and used to transform *Yarrowia* strains HY015. Transformants were obtained via selection on SC-ura plates. Transformants grown on these plates were picked and restreaked onto fresh SC-ura plates. 33 transformants were selected and random and patched onto fresh SC-ura plates, then grown in CM-ura with 2% glucose, 1% lactose and 0.25 M citrate and 2'FL levels were measured after 55 h. Several transformants were found to produce significantly more 2'FL than strain HY011 (the ura+ version of the parent strain HY015B). 11 of these transformants were streaked for single colonies, and 3 colonies from each transformant were re-evaluated for 2'FL production. All of these strains were found to produce more 2'FL than strain HY011. One of these strains was designated HY028.

Example 16

Fermentative Production of 2'FL at pH 5.5 Versus pH 6.3

This example shows production of 2'FL by strain HS0007 as described in Example 14, when the fermenter pH is controlled at either 5.5 or 6.3. Production of 2'FL was initiated after a period of biomass growth, controlled by the glucose feed rate, by the addition of copper sulfate to increase expression of FutC_Hp and then addition of lactose.

Inoculum Preparation

A frozen vial of HS0007 (prepared as described in Example 14) was thawed and transferred to 10 mL synthetic complete medium with 2% glucose in a 125 mL vented shake flask, and incubated at 30° C. and 300 rpm shaking for several hours. Two seed flasks were prepared using this culture in two 1 L vented shake flasks with 100 mL of synthetic complete medium with 3% glucose for further growth at 30° C. and 300 rpm shaking. When the culture reached OD600 about 10, the two flask cultures were used to inoculate two 1 L fermenters, prepared as described below. The synthetic complete medium composition is as follows: yeast nitrogen base without amino acids (Difco), 6.7 g/L; Synthetic Complete Drop-out:(Kaiser)-his-ura (Formedium, England), 1.8 g/L; glucose was added to 2% (w/v) for the inoculum growth. The pH was adjusted to 5.2 with 20% potassium hydroxide and the medium filter sterilized through a 0.22µ filter.

Fermenter Preparation and Operation:

Fermentations were carried out in 1 L Biostat B DCU3 fermenters (Sartorius, USA). Two fermenters were prepared with 600 mL 0.9% (w/v) NaCl solution and sterilized at 121° C. for 30 minutes. After cooling, the salt solution was pushed out and 700 mL medium, which had been previously filter sterilized, was pumped into the fermenters. Fermenter medium was comprised of, per liter: 5 g ammonium sulfate, 6 g potassium phosphate monobasic, 2 g magnesium sulfate heptahydrate, 2 mL of a trace mineral solution (prepared in 1 L water: 15 g EDTA, 4.5 g zinc sulfate heptahydrate, 0.8 g manganese chloride dehydrate, 0.3 g cobalt chloride hexahydrate, 0.3 g copper sulfate pentahydrate, 0.4 g disodium molybdenum dehydrate, 4.5 g calcium chloride dihydrate, 3 g iron sulfate heptahydrate, 1 g boric acid, 0.1 g potassium iodide) and 2 mL of a vitamin mixture (in 1 L water, 50 mg biotin, 1 g Ca-pantothenate, 1 g nicotinic acid, 25 g myo-inositol, 1 g pyridoxol hydrochloride, 0.2 g p-aminobenzoic acid), 20 g glucose and 0.2 mL Sigma Antifoam 204.

The temperature of the fermenters was maintained at 30° C., and pH controlled at 5.5 (V1) or 6.3 (V3) with 20% ammonium hydroxide throughout the entire fermentations. During the initial hours of fermentation, aeration was controlled at 0.4 standard liters per minute (SLPM), and dissolved oxygen controlled at 20% by agitation. Beginning at approximately 46 hours, the aeration rate was adjusted in step-wise fashion up to 1.5 SLPM to maintain the dissolved oxygen level. Samples were drawn and analyzed for optical density at 600 nm and for glucose concentration by a YSI Select Biochemistry Analyzer (YSI, Inc., Yellow Springs, Ohio). Fermenters were run with glucose limitation using a programmed exponential ramp feed of 50% (w/w) glucose controlled with an exponential ramp of 0.1/hr. The glucose feed was initially delivered via syringe pumps (KD Scientific, Inc., USA) and then by peristaltic pumps (onboard—supplied by Sartorius) after approximately 44 hours. When the optical density was about 50, $CuSO_4$ was added to a final concentration of 100 µM. When the optical density was about 100, lactose was added to a final concentration of 50 g/L. Additional lactose was added as needed to maintain excess.

Samples from both fermenters were centrifuged to separate the biomass and cell pellets. Both fractions were stored at −80° C. until analysis at the end of the experiment. Intracellular and extracellular 2'FL amounts from the cell pellets were determined as described in Example 5. The results are shown in table 21.

TABLE 21

2'FL produced after 78.6 hours fermentation (~33 hours post lactose addition)

| Fermenter | pH | Total 2'FL (g/L) |
|---|---|---|
| V1 | 5.5 | 4.7 |
| V3 | 6.3 | 8.0 |

Example 17

Fermentative Production of 2'FL Employing at pH Shift to 6.3 Upon Addition of Lactose Co-Substrate Fermenters were prepared as described above except that the amounts of potassium phosphate monobasic, magnesium sulfate heptahydrate, trace mineral solution and vitamin mixture were doubled. The glucose feed rate was increased to 0.12h. One fermenter (V2) was held at pH 5.5 throughout, while fermenter V3 started at pH 5.5 and was shifted to 6.3 upon addition of lactose. $CuSO_4$ and lactose additions were made as described in the example above. Aeration was again controlled at 20% dissolved oxygen, as described in the example above. The results from these fermentations are shown in Table 22. The fermenter that was shifted to pH 6.3 was able to hold that pH with base addition for approximately 30 hours before it drifted up to pH 7.8.

TABLE 22

2'FL produced after 58 hours (22 hours post lactose addition), the time point before pH control was lost for fermenter V3.

| Fermenter | pH | Total 2'FL (g/L)-58 h |
|---|---|---|
| V2 | 5.5 | 5.0 |
| V3 | 5.5 → 6.3 (with lactose addition) | 9.9 |

Example 18

Production of 2'FL by Saccharomyces and Yarrowia Using the pH Shift Regime

This example shows production of 2'FL by Saccharomyces strain HS0007 (Example 14) and Yarrowia strain HY028 (Example 15).

For the Saccharomyces fermentations (V1 and V2), the glucose-limited feed regime described in the preceding example was further modified to include, per L, 0.1 g iron (II) sulfate heptahydrate and 2 g citric acid in the medium. The feed rate was held at 0.12/h for both fermenters. Minor adjustments to feed rate made after 37 hours resulted in a 10% decrease in glucose delivery to V2 versus V1 by the end of the fermentations (71h). The fermenters also differed by dissolved oxygen control using the air flow rate. The maximum rate for V1 was 1 SLPM and for V2 was 1.5 SLPM. For the Yarrowia fermentations (V3 and V4), fermenter medium contained, per liter: 5 g ammonium sulfate, 12 g potassium phosphate monobasic, 2g magnesium sulfate heptahydrate, 20 g Difco yeast extract, 10 mL Yarrowia metal solution (consisting of 10 g/L citric acid, 1.5 g/L $CaCl_2.2H_2O$, 10 g/L $FeSO_4.7H_2O$, 0.39 g/L 10 g/L $ZnSO_4.7H_2O$, 0.38 g/L $CuSO_4.5H_2O$, 0.2 g/L $COCl_2.6H_2O$, and $MnCl_2.4H_2O$), 1.5 mg thiamine hydrochloride, 1 mL Sigma Antifoam 204, and 30 g glucose. Glucose was initially maintained in excess and then fed at approximately 20 g/h after 23 hours. Minor adjustments to feed rate made later in the fermentation resulted in 6% decrease in glucose delivery to V3 versus V4 by the end of the fermentations (48 h). The pH was shifted up to 7 upon addition of lactose, which occurred ~24 hours after inoculation (100 OD cell concentration). Fermenters differed by dissolved oxygen control, accomplished by different air flow rates. The maximum rate used for fermenter V4 was 1 SLPM while the maximum for V3 was 1.5 SLPM.

Table 24 contains data showing the Total 2'FL production from strain HS0007 after about 71 hours post fermentation and strain HY028 after about 48 hours post fermentation. Total 2'FL was determined according to the chromatographic protocol described below:

Yeast culture supernatants were diluted in water and injected onto a Dionex ICS 3000 Chromatography System equipped with a CarboPac PA1 column (Thermo Scientific, Catalog #057178, Guard column #: 057179). The mobile phases contained (A) water, (B) 400 mM sodium hydroxide, and (C) 1M sodium acetate containing 100 mM sodium hydroxide. 10 ul samples were injected onto the column and compounds were eluted employing the gradient indicated below. 2'FL was detected via pulsed amperometric detection and quantitated based on comparison with authentic standards as confirmed in Table 23.

TABLE 23

(Gradient Table)

| Time (min) | % A | % B | % C | Flow (mL/min) |
|---|---|---|---|---|
| 0 | 74.9 | 25.0 | 0.1 | 1.0 |
| 10.50 | 72.0 | 25.0 | 3.0 | 1.0 |
| 11.00 | 15.0 | 55.0 | 30.0 | 1.0 |
| 12.50 | 15.0 | 55.0 | 30.0 | 1.0 |
| 13.00 | 74.9 | 25.0 | 0.1 | 1.0 |
| 15.50 | 74.9 | 25.0 | 0.1 | 1.0 |

TABLE 24

2'FL production by HS0007 after 71.3 hours fermentation (35.7 hours post lactose addition) and HY028 after 48.1 hours fermentation (25.8 hours post lactose addition).

| Fermenter | Strain | pH | Total 2'FL (g/L) |
|---|---|---|---|
| V1 | HS0007 (*S. cerevisiae*) | 5.5 → 6.3 (with lactose addition) | 17.3 |
| V2 | | | 18.1 |
| V3 | HY028A (*Y. lipolytica*) | 5.5 → 6.3 (with lactose addition) | 21.7 |
| V4 | | | 26.2 |

SEQUENCE LISTING (260 sequences)

SEQ ID NO: 1 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 2 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 3 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 4 - protein, 560 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWFHQTREVLTTTLMI

SEQ ID NO: 5 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 6 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 7 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 8 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 9 - protein, 567 aa, Saccharomyces cerevisiae
MSGVNNTSANDLSTTESNSNSVANAPSVKTEHNDSKNSLNLDATEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKQIRGTLVQLYQLMCTMGIFLGYCTNYGTKNYHNATQWRVGLGLCFAWTTFMVSGMMFVPESPRYLIEVGKDEEAKRSLSKSNKVSVDDPALLAEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDDRPIYKRFFSS

SEQ ID NO: 10 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 11 - protein, 567 aa, Saccharomyces cerevisiae
MSGVNNTSANELSTTMSNSNSAVGAPSVKTEHGDSKNSLNLDANEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKRSLSKSNKVSVDDPALLVEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 12 - protein, 457 aa, Saccharomyces cerevisiae
MGLIVSIFNIGCAIGGIVLSKVGDIYGRRIGLITVTAIYVVGILIQITSINKWYQYFIGRIISGIGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKHSLSKSNKVSVDDPALLAEYDTIKAGIEIEKLAGNASWSELLSTKTKVFQRVLMGVIIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCFVIVSETFPLRAKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 13 - protein, 564 aa, Saccharomyces cerevisiae
MSSAQSSIDSDGDVRDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWALIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGISSEESKTEKKDWKKFLKFSKNSD

SEQ ID NO: 14 - protein, 540 aa, Saccharomyces cerevisiae
MTAQIPYQHSSGYISHFHNNELDAGRGRDYNVTIKYLDDKEENIEGQAAKISHNASLHIPVLLCLVISLGGFIFGWDIGTIGGMTNMVSFQEKFGTTNIIHDDETIFVSTKKLTDLQIGLIISIFNISCGVGALTLSKIGDWIGRKGGIWFALVVYCIGITIQILSYGRWYFLTLGRAVTGIGVGVTTVLVPMFLSENSPLKIRGSMVSTYQLIVTFGILMGNILNFICERCYKDPTQNIAWQLPLFLGYIWAIIIGMSLVYVPESPQYLAKIKNDVPSAKYSFARMNGIPATDSMVIEFIDDLLENNYNNEETNNESKKQSLVKRNTFEFIMGKPKLWLRLIIGMMIMAFQQLSGINYFFYYGTSVFKGVGIKDPYITSIILSSVNFLSTILGIYYVEKWGHKTCLLYGSTNLLFYMMTYATVGTFGRETDFSNIVLIIVTCCFIFWFAITLGPVTFVLVSELFPLRTRAISMAICTFINWMFNFLISLLTPMIVSKIDFKLGYIFAACLLALIIFSWILVPETRKKNEQEINKIFEPE

SEQ ID NO: 15 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 16 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKIDKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEETQLLYEEGIKPWKSASWVPPSRRGASSRETEAKKKSWKEVLKFPKSFN

SEQ ID NO: 17 - protein, 564 aa, Saccharomyces cerevisiae
MQSSTESDRDIQDGPDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWTLIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGIPSEESKTEKKDWKKFLKFSKGSD

SEQ ID NO: 18 - protein, 574 aa, Saccharomyces cerevisiae
MAVEENNMPVVSQQPQAGEDVISSLSKDSHLSAQSQKYSNDELKAGESGSEGSQSVPIEIPKKPMSEYVTVSLLCLCVAFGGFMFGWDTGTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGHRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 19 - protein, 616 aa, Saccharomyces cerevisiae
MKNIISLVSKKKAASKNEDKNISESSRDIVNQQEVFNTEDFEEGKKDSAFELDHLEFTTNSAQLGDSDEDNENVINEMNATDDANEANSEEKSMTLKQALLKYPKAALWSILVSTTLVMEGYDTALLSALYALPVFQRKFGTLNGEGSYEITSQWQIGLNMCVLCGEMIGLQITTYMVEFMGNRYTMITALGLLTAYIFILYYCKSLAMIAVGQILSAIPWGCFQSLAVTYASEVCPLALRYYMTSYSNICWLFGQIFASGIMKNSQENLGNSDLGYKLPFALQWIWPAPLMIGIFFAPESPWWLVRKDRVAEARKSLSRILSGKGAEKDIQVDLTLKQIELTIEKERLLASKSGSFFNCFKGVNGRRTRLACLTWVAQNSSGAVLLGYSTYFFERAGMATDKAFTFSLIQYCLGLAGTLCSWVISGRVGRWTILTYGLAFQMVCLFIIGGMGFGSGSSASNGAGGLLLALSFFYNAGIGAVVYCIVAEIPSAELRTKTIVLARICYNLMAVINAILTPYMLNVSDWNWGAKTGLYWGGFTAVTLAWVIIDLPETTGRTFSEINELFNQGVPARKFASTVVDPFGKGKTQHDSLADESISQSSSIKQRELNAADKC

SEQ ID NO: 20 - protein, 614 aa, Saccharomyces cerevisiae
MKGLSSLINRKKDRNDSHLDEIENGVNATEFNSIEMEEQGKKSDFGLSHHEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQLTGPSVDLVGNRYTLIMALFFLAAFIFILYFCKSLGMIAVGQALCGMPWGCFQCLTVSYASEICPLALRYYLTTYSNLCWTFGQLFAAGIMKNSQNKYANSELGYKLPFALQWIWPLPLAVGIFFAPESPWWLVKKGRIDQARRSLERTLSGKGPEKELLVTMELDKIKTTIEKEQKMSDEGTYWDCVKDGINRRRTRIACLCWIGQCSCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEMPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRNTSSVVNK

SEQ ID NO: 21 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLTVSYASEICPLALRYYLTTYSNLCWAFGQLFAAGIMKNSQNKYANSELGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFISWWASKYCGRFDLYAFGLAFQAIMFFIIGGLGCSDTHGAKMGSGALLMVVAFFYNLGIAPVVFCLVSEIPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRNTSSVVNK

SEQ ID NO: 22 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQVTGPSVDYMGNRYTLIMALFFLAAFIFILYFCKSLGMIAVGQALCGMPWGCFQCLTVSYASEICPLALRYYLTTYSNLCWTFGQLFAAGIMKNSQNKYANSELGYKLPFALQWIWPLPLAVGIFLAPESPWWLVKKGRIDQARRSLERILSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEMPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTPSVVNK

SEQ ID NO: 23 - protein, 608 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPLKTSLITTPREISKLPLQRNSNVSHH

SEQ ID NO: 24 - protein, 567 aa, Kluyveromyces lactis
MSNQMTDSTSAGSGTEHSVDTNTALKAGSPNDLKVSHEEDLNDLEKTAEETLQQKPAKEYIFVSLCCVMVAFGGFVFGWDTGTISGFVNQTDFLRRFGQEKADGSHYLSNVRTGLIVSIFNIGCAVGGIVLSNIGDRWGRRIGLITVIIIYVIGIIIQIASVDKWYQYFIGRIISGLGVGGITVLSPMLISETAPKHLRGTLVSCYQLMITFGIFLGYCTNYGTKNYSNSVQWRVPLGLCFAWAIFMVLGMMFVPESARFLVETDQIEEARKSLAKTNKVSIDDPVVKYELLKIQSSIELEKAAGNASWGELITGKPSMFRRTLMGIMIQSLQQLTGDNYFFYYGTTIFQSVGMDDSFETSIVLGIVNFASTFFALYTVDHFGRRNCLLYGCVGMVACYVVYASVGVTRLWPDGPDHPDISSKGAGNCMIVFACFYIFCFATTWAPIAYVVISESYPLRVKGKAMAIASASNWIWGFLIGFFTPFITSAIHFYYGYVFMGCMVFAFFYVYFFVPETKGLTLEEVNEMYSEGVLPWKSSSWVPSSRRGAEYDVDALQHDDKPWYKAML

SEQ ID NO: 25 - protein, 551 aa, Kluyveromyces lactis
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 26 - protein, 566 aa, Kluyveromyces lactis
MSELETGTAAHGTPVENKSVSSSQASTPTNVGSRDDLKVDDDNHSVDAIELPKKPRSAYITVSILCLMVAFGGFVFGWDTGTISGFVNQTDFIRRFGQEKADGSHYLSNVRTGLIVSIFNIGCAIGGIILSKLGDMYGRRIGLMIVVLIYVVGIIIQIASIDKWYQYFIGRIISGLGVGGISVLSPMLISETAPKHIRGTLVSFYQLMITFGIFLGYCTNYGTKTYSNSVQWRVPLGLCFAWAIFMITGMLFVPESPRFLVEKDRIDEAKRSIAKSNKVSYEDPAVQAEVDLICAGVEAERLAGSASIKELFSTKTKVFQRLIMGMLIQSFQQLTGNNYFFYYGTTIFNSVGMDDSFETSIVLGIVNFASTFVAIYVVDKFGRRKCLLWGAAAMTACMVVFASVGVTRLWPDGANHPETASKGAGNCMIVFACFYIFCFATSWAPIAYVVVAESYPLRVKAKCMAIATASNWIWGFLNGFFTPFITSAIHFYYGYVFMGCLVAMFFYVFFFVPETKGLTLEEVQEMWEEGVLPWKSSSWVPSSRRNAGYDVDALQHDEKPWYKAML

SEQ ID NO: 27 - protein, 587 aa, Kluyveromyces lactis
MADHSSSSSSLQKKPINTIEHKDTLGNDRDHKEALNSDNDNTSGLKINGVPIEDAREEVLLPGYLSKQYYKLYGLCFITYLCATMQGYDGALMGSIYTEDAYLKYYHLDINSSSGTGLVFSIFNVGQICGAFFVPLMDWKGRKPAILIGCLGVVIGAIISSLTTTKSALIGGRWFVAFFATIANAAAPTYCAEVAPAHLRGKVAGLYNTLWSVGSIVAAFSTYGTNKNFPNSSKAFKIPLYLQMMFPGLVCIFGWLIPESPRWLVGVGREEEAREFIIKYHLNGDRTHPLLDMEMAEIIESFHGTDLSNPLEMLDVRSLFRTRSDRYRAMLVILMAWFGQFSGNNVCSYYLPTMLRNVGMKSVSLNVLMNGVYSIVTWISSICGAFFIDKIGRREGFLGSISGAALALTGLSICTARYEKTKKKSASNGALVFIYLFGGIFSFAFTPMQSMYSTEVSTNLTRSKAQLLNFVVSGVAQFVNQFATPKAMKNIKYWFYVFYVFFDIFEFIVIYFFFVETKGRSLEELEVVFEAPNPRKASVDQAFLAQVRATLVQRNDVRVANAQNLKEQEPLKSDADHVEKLSEAESV

SEQ ID NO: 28 - protein, 576 aa, Kluyveromyces lactis
MDSSSSVLQKDTKQVDIEHREEASSNDQLVDQNALLDSFLGDVDGAASADATEKSMSLLEGLRKYPKAVGWSLVVSTGLIMEGYDTAFINNLFALPIFRTTFGEYNQANDIWEIPSKWQIGLGMCVACGEIIGLQITGIFADRYGYRLVLIAGLVLLIAFNFILYFANSLTMIAIGQILSGIPWGSFQTLCVSYASEVCPLVLRYYLTTYINLCWLIGQVIAAGVLKACQEHLANDELGWRLPFALQWIWPVPLIVGIYLAPESPWWLVRKGRIDQAKRSVTRILTLPTSEKDKLTDIMITKMRMTVEKENRLASESSSYMDCFKGIDARRTRITCLTWVMQNLTGSALMGYSTYFYEKAGLDTSAAFTFSIIQYVIGIVGTLTSWFLSSRAGRFTILFWGVFFQTIVMFITGGLGFSSSEGASWGAGSMLLIYNFFYNSTLGPVVYCVVSEIPSDRLRTKTVVLARNSYNLIAIVNSILTPYMLNSDQWNWGAKTGLFWGGLAAISLVWAYFDLPETKGRTFAELDELFHQRVPARKFNSTHVEPFSRETIMKDLDVNPEVWLETIEEGDTDIKK

SEQ ID NO: 29 - protein, 515 aa, Yarrowia lipolytica
MGLANIINRGEKPEGSAFMAAFVAVFVAFGGILFGYDTGTISGVMAMPFVKKTFTDDGLEFTSEQTSLITSILSAGTFTGAISAPWASDTLGRRLGLILFCVVFSVGAILQTAATGRTLLIVGRVVAGLGVGGVSSIVPLYQSEVAPKWIRGAVVSIYQFAITIGLLLAAIVNNATKNKDNSASYRIPLGLQLLWAVILSGGLILLPETPRFWIKKGEYDKAADSLRRLRRLPVEHEAVQKELLEIQSSHDHEMQIGSATWAACFSPKGSQLKRMLTGIAIQALQQLTGINFIFYYGTEFFKKSNISNPFLIQMITNIVNVVMTIPGIMFVDRVGRRKLLLIGAIVMCSSEFIVAAVGTAIDNETSSKVLIAFTCTFIAGFAATWGPIAWVVIGEIFPLRIRAKGVALCAASNWLFNFAIAFATPYLVDEAPGSAGLKTKVFFIWGGCNFLCIAFTYFFIYETKGLTLEEVDQMYAEIKIASRSHQFVPTTRVAAYDEHASDDKKDGQHVYIESV

SEQ ID NO: 30 - protein, 494 aa, Yarrowia lipolytica
MAIIVAVFVAFGGLLYGYDTGTIAGIMTMGYVKEHFTDFGKNDFTSGQSSLTTSILSVGTFTGAIVAPLAADTAGRRLGLLLYCLVFSVGAILQTVTTGRVLLIVGRVIAGLGVGGISSIVPLYQSEVSPKWIRGAVVSVYQFAITVGLLLAAIVNNATKDRPNTSSYRIPLGIQLIWALILSAGLVFLPETPRFWVKKNRPEKAAEALSRLRRLPTDSKPVKKELLELQKSFEMEMEVGNSSWKACFSPHGSQLKRLLTGVSIQALQQLTGINFIFYYGTNFFKTAGIKDPFVVSMITSAVNVAFTLPGILFVDKVGRRKLLLIGAVVMCVSELIVAAVGAALDSQVSSKVLIAFTCTFIAGFASTWGPIAWVVVAEIFPLRIRAKGVAISVAANWIFNFAIAFATPYLVDKKPGSAGLESKVFFIWGGCNFLAIAFVYLFVYETKGLSLEQVDEMYSEVKYAWQSDRFQTEIMSGKTEVSPDQSCDSGFDSD

SEQ ID NO: 31 - protein, 533 aa, Yarrowia lipolytica
MSTSAMTDDYPMAEVSITEETKMPEPAKKSQLLVILLCLFAAMGGFVFGYDTGTISGFINMDPFLESFGEADESGVFFLSRIRAGLIVGLFSIGAFLGTLLGGFLADKVGRKKGIVYVAMVYIVGMLIQITAFTAWYQIAIGRVIGGVGIGALSVLVPMFQSETAPQNLRGALVSSFQLFITLGIFIGFSVCYATKSRLDTGAYRIPMGLCFAWAFILLIGMCFMPESPRFLVSIGRIEEARKAMAMTNQVPLHDAVIDEELKAIENSVIREKSAGKATWKELFTGEPRMGYRLTLGILVQVLQQLCGANYFFYYGTSIFKAIGMSDSFATSMIFGGINLLSTFGGLYIVDRFGRRKCLLGGAMVMFVCFLVYSTVGFAALYPNGDTTLPARKAVGDVMILFTCIFIAAFASTWAPIAFVVVSETFPLRMRSKGMAVATGGNWMINFLVSFLTPFITSSIGFKYGYVFTACIGFAIIFVFFFIPETKGLSLEDVDELYASGVSARNSPNWVPSSKKQEVNEPKNSMTDFSESS

SEQ ID NO: 32 - protein, 540 aa, Yarrowia lipolytica
MSLDKNRQITTSESSSGSSADEGTHIMRGLTSTSTQDETTGSISEGNLEAEKISPFVFVLVALASISGFLFGYDTGYVSGALVVIKEDLGRALSNGDKELITASTSLGALLGGVIAGAMCDFFGRKWVITFANILFLVGAAIQCGAHAVWTMIGGRFVMGWGVGIASLCAPLYISELAPTRIRGRLVVLNVLAITGGQLVAYGIGAGMAHVHQGWRILVGLSMVPAFVQMVIFVFMPETPRYLVRKNKIAEAKKVLAKTYATDDDNLLDRKLHELMLHNAYKESGLSTMARARNTMKELYCVPSNLRALIIACGLQGIQQFCGFNSLMYFSATIFEVVGFDNATAVSIIVAGTNFVFTIVAFMVIDRIGRRRILLGTIWGMSLGLVVNAIAFHFLDKQKEKNPNHELDKEHISGWAYVVLVAQLVYVAFYATGIGNVPWQQSELFPISVRGVGTGMATATNWAGSLIVSSTFLTMLENITPTGTFSFYAGLCALGEVFVFFLYPETSGMDLEQIQQLLTGGFNIKESMRLSDEAKRGYKK

SEQ ID NO: 33 - protein, 545 aa, Yarrowia lipolytica
MIGNAQINQVGALQHRFPKLHNPYLTAAVATMGGLLFGFDISSVSAFVDTKPYKEYFGYPTSIQQGGITASMAGGSFLSSLVAGWISDRLGRRFAIHFASFWWVVGAAIQSSAQNKGQLIAGRLISGLGIGLGSSVIPVYISELSPKKIRGRLVGLFQWAVTWGILIMFYISFGLSNIHGVAGFRVAWGLQIIPGLLMSLGCLFLEESPRWLAKQDNWDESVRVLRAIHQGGYGTEEDILLEIEEIREAVRIEHETKNLRFWHLFQKDSINRTMVGIWAQIWQQLTGMNVMMYYIVLIFTMAGYTGNANLVASSIQYVINMIMTIPALLFIDRVGRRPLLLFGSIVMMIWLFAVAGILAVYGTQIPGGLDGDAFTTIVIEPTHKPAQKGVIACSYLFVATFAPTWGPGIWLYCSELFPLKQRAVAAGVTASANWIFNFALALFVPSAFKNINWKTYIIFGVFCIVMTIHVFVLFPETKGKTLEEIDMMWAARVPAWRTANWVPDHVPGALPEDEKHSEEMVEAVESNEEEPKIASANVDAPPSQL

SEQ ID NO: 34 - protein, 602 aa, Yarrowia lipolytica
MARLCLSQTGSIRSRRRLWAGVGTIADFHTPDPPHIFHACACTKRSHMHSPDSLSTLFSTNFLYTSQLTMYKVHNPYLTAAVATMGGMLFGFDISSVSAFVGEDQYMQYFGHPTSIQQGGITASMAGGSMLSCSFAGFISDRIGRKPTIQIAAAWWIVGAAIQCSAQNMGQLIAGRVISGIGIGIGSSQIPVFISELSPKKIRGRLVGCFQWAVTWGILIMFYISFGCSYIKGPASFRLAWGIQMIPGAMLAFGMMFLDESPRWLASKDRWEEAIQIIRSVNGNYGTEEDILMEIEDLREVVRIDHESKTVMVWDLFRKDSINRTMVGIWAQIWQQLTGMNVMMYYVVIIFKMAGYSGKSSVLVSSSIQYIINVVMTIPALLFIDKIGRRPLLIVGCLFMMTWLFAVGGMLGAYGTQMPGGLPANPEKNIAADPYTTIFIDDNHKTARKAIIACCYLFVASFAPTWGPGIWLYCSEIFPNKQRAMANSITAGANWAFNFALAMFVPTAFKNINWKTYIIFGVFCVVMCIHVFLLFPETKGKTLEEIDMMWDAKVPAWRTASWVPDHMPSRYAEKDLDEKPMDELAEEPSHEEDPHPQYTETV

SEQ ID NO: 35 - protein, 554 aa, Yarrowia lipolytica
MYKVHNPYLTAAVATMGGMLFGFDISSVSAFVGEDNYMNYFGHPTSFQQGGITASMAGGSMLSCAFAGYISDRVGRKPTIQFAAAWWMVGASIQCSAQNMGQLIAGRAISGLGIGLGSSQIPVFISELSPKKIRGRLVGCFQWSVTWGILIMFYISFGCSYIKGHSSFRLAWGIQLIPGAMLAFGMMLLDESPRWLASKDRWEEAIQIIRSINANYGSEEDILMEIEDLREVVRIDHESKSVTIWDLFRKDSINRTMVGVWAQIWQQLTGMNIMMYYVVIIFKMAGYSGKSAVIVSGSIQYIINVVMTIPALLFIDKIGRRPLLLCGSMLMATWLLAVGGMLGAYGIQMPQGLPAVPSKNQAADPYTTIYIPDNQAPARKAIIACCYLFVASFAPTWGPGIWLYCSEIFPNKQRALANSLTAGANWGFNFALALFVPTAFKNINWKVYIIFGVFCIVMSIHVFLLFPETKGKSLEVIDQMWDARVPAWKTASWVPDHMPSHYAGDQEEKPTDELAEAPFHEENAPVNTETPPHEDEPTFAETEPKTQYPGTEHV

SEQ ID NO: 36 - protein, 532 aa, Yarrowia lipolytica
MFSLTGKPLLYFTSVFVSLGVFLFGYDQGVMSGIITGFYFKEYFHEPTRAEIGTMVSILEVGAFVSSLMVGRIGDIIGRRKTIMYGAFIFIIGGAFQTFAVSMSEMILGRVVAGFGVGMLSTIVPVYQSEISPPHNRGKLACIEFTGNIVGYASSVWVDYFCSFINSNMSWRIPLFLQCAMGALLFGGSFLIAETPRWLLDNDHDEEGLVVLANLHGGGDIDSPLAKQEYREIKQSVLIHRLEGERSYTDMWKKYKKRVLIAMSSQMFAQLNGINVISYYAPLVFEEAGWVGRSAILMTGINGIVYVCSTIPPWYLVDKWGRRPILLSGAVIMAISLASVAFWMRLDFAHTPALVVISVVIFNAAFGYSWGPIPWLYPPEIMPLTIRAKGASLSTATNWAFNWLVGYMTPILQETIKWRLYLMHAAFCSLSFVLVYFTYPETSGINLEDMDSLFGDKSVVNTPDSRSLLGDRDTPEPDVPHSYTDAATDRLPAGMQGYGSAPSSRGGSVVGSPRRGNSVVGSPKRDFPQPPV

SEQ ID NO: 37 - protein, 592 aa, Yarrowia lipolytica
MGRNWLAFSQASTEVKTEFLGLRGQKLHRAVAFIAGMGFLLFGYDQGVMGGLLTLPRFIHQFPKMDTSDYVPEETRKFNTTIQGVSVGIYEIGCMIGALFTMWAGDKLGRRRMIFWGSIIMTIGAILQCASYSLGQFITGRVVSGVGNGFITATVPMFQSECAKPERRGALVMMEGALITGGIALSYWIDFGFYWVNNDADWRFPIAFQIIFSMFLTFTVMSLPESPRWLVKKQRFDEAAGVFSALEDVPIDDPYVIDQIAEVKESIMMEQLAQLGVDGSEAREKIASGEFQMGAELPFLEQMKLLFTFGKKKNFHRTMLAYWNQVMQQITGINLITYYAAYIYETSVGMNATNSRILAACNGTEYFLASWVAFYTIERFGRRKLMLFGAIGQACTMAILTGTVYAASPPEDGGLDNSGAGIAAAVFLFVFNTFFAIGWLGMTWLYPAEITSLEIRAPANGLSTSGNWVFNFMVVMITPVAFDTIKWKTYIIFACINAAMVPVVYFFYPETAGRSLEEIDKIFAESNPRTPWDVVGIARRMPRESALTRRKQGVNQTFDNSNEKAVVEENTESAVGSTTGSASPSFENVSQA

SEQ ID NO: 38 - protein, 599 aa, Yarrowia lipolytica
MILFWLHRGVFALSEYRIYIRGQVPRSRSLFLTARLTMLFSKASGTKYFGLKGKTLQRAIGGIAGLGFFLFGYDQGVMGGLLNLKTFREQFETINTVDDTSLHTATIQGTAIAVYELGCMVGALSTIYLGDKLGRRKVIYFGTWIIIIGAIIQTASYHLGQLIVGRVVAGIGNGLITATVPMWQSECARPEDRGLMVMIEGCLISGGIALSYWLDFAFFFVKVGSMDWRFPVAFQILIALIIVAFVLEFPESPRWLVKVGREEDAREVWAALENCGPNDDYINYEIHEVKKNLAAEEQMTSWQTFKLIFTYGERKHFHRACLAFWNQAMQQLTGINLITYYAAKIYQDSLHMDDVVSRALAAANGTEYFMASFIPFWSIERFGRRKLMLFGAVGQACTMGILTGTAWAADPNNKDNRAAGIAACVFLFVFNSFFAIGWLGMTWLYPAEITSLEVRAPVSGISTASNWLFNFTVVMICPVGFNSIQSYTYTIFAAINACMVPVIYFLYPETAGRSLEEIDEIFKESNPKTPWDVVGIAARMPKRDHYNYDIESRGNSMGEQYPEGEPKPEHEEVPEGYTSETAGENSNSSVEYPDTTTHQ

SEQ ID NO: 39 - protein, 575 aa, Yarrowia lipolytica
MKLFKREAPQGTVRTSYFGSRGTRLHRIIAAVAGIGFLLFGYDTGVMGSLLTLPTFIHQFPTMDSTSPHLDAKTKSFHSTVQGTAVAIYEIGCMLGALFTMWGGDKLGRRKIIFIGSIIVTIGAILQCASYSLGQFVTGRVIAGIGVGFTTATVPMFQAECARPERRGALVMLGGALTTGGIALSYWIDFGFYFVKRNDSDWRFPVAFQILFSLILSCTVLYLPESPRWLIKKGRYEEAAGVFAALEDVPIDDIYVSQQLMQVKESLMVGQLAQEGIEGDEARRRIASGDVELGEEPPFRKQLVLLFTFGKKKHLHRAMLAYSQQIMHQMCGINLISYYAAYIFQTSIGMSPLNSRILAACDGTEYFLASWIAFYTIERFGRRKLMLFGTIGQACTMAILAGTVYAASSVKDGGLDKPQAGIAAAVFLFVFNTFFSIGWLGMAWLYPAEIAPIEIRAISQGLSTSGNWVFNFLVVMITPVAFNSIKWRTYIIFACINVAMVPSIYFFFPETMGRSLEEIDLIFEDSNPRTPWDVVGIAKRLPRGTLDGVVPSDMELEKEIEHVSVKSLGGATIRG

SEQ ID NO: 40 - protein, 578 aa, Yarrowia lipolytica
MKLQVPAFARSSSDVKTSFMGARGQKLHNLVAAIAGLGFLLFGYDQGVMGGLLTLDTFIQQFPKMDTSDYLPPKVKTFNTTIQGTAVGIYEIGCMIGALFTMWAGDKLGRRYMIFFGSIIMTIGAILQCASYSLGQFIAGRVISGIGNGFITATVPMLQSECAKPERRGKLVMLEGALITAGIALSYWIDFGFYWVRTNDADWRFPIAFQIVFSLVLTFTIMSLPESPRWLVKKQRFEEAAGVFAALEDVPLDDPYVINQITSVKESIMMEQLAQLGVDGVDARRKIQSGEFQMGQELSFIGQMKLMFTFGKKKNFHRTMLAYWNQVMQQVTGINLITYYAAYIYQTSVGMNATDSRILAACNGTEYFMASWVAFYTIERFGRRKLMLFGAVGQACTMAILTGCVYAASKPEDGGLDMQGAGIAAAVFLFVFNTFFAIGWLGMTWLYPAEISSLEIRAPANGLSTSGNWAFNFMVVMITPVAFNSIKWKTYIIFACINAFMVPMVYFFYPETAGRSLEEIDMIFAESNPRTPWDVVGIANRLPKNSVATYDDYEAGEQEEKAIVETAESVSHDSAEFQ

SEQ ID NO: 41 - protein, 565 aa, Yarrowia lipolytica
MGFRGQRLHHYVATVAGMGFLLFGYDQGVMGGLLTLPSFVKQFPKMDTSDYLPPDVKSFNTTIQGTAIAIYEIGCMMGALFTMWGGDKVGRRYIIFYGSIIMTIGAVLQCASYSLGMFITGRVVSGVGNGFITATVPMLQSECAKPEKRGKLVMLEGALITAGIALSYWIDFGFYWVKANDADWRFPVAFQIVFCLFLFFTVLTIPESPRWLVKKGRFEEAAGVFAALEDVDIEDPYVVTQITYVKESIMLEQLAQLGIDGPAAREKIAAGEFSMGEELPFLSQMKLMFTFGKKKNFHRTMLAYWSQVMQQITGINLITYYAAYIYETSVGMTPTNSRILAACNGTEYFLASWIAFYTIERFGRRKLMIFGAAGQAATMAILTGCVYAASSPADGGLDNQSAGVAAAVFLFVFNTFFAIGWLGMSWLYPAEISSLEIRAPANGLSTSGNWVFNFMVVMITPVAFDTIKWKTYIIFAVINAAMVPVVYFFYPETAGRSLEEIDQIFADSNPKTPWDVVWIARRLPKSTAVDHNLVEPRILLEEKTALETVESVSPTPSDQEETRHV

SEQ ID NO: 42 - protein, 582 aa, Yarrowia lipolytica
MKDFLAFTKASTEVKTVFFGCRGTPLHRVVAAIAGIGFLLFGYDQGVMGGLLTLPTFIQEFPSMDTSDHLPPDVKTHNTTIQGTAVGIYEIGCMLGALFTMWAGDKLGRRYMIFWGSIIITIGAILQCAAYSLAQFIVGRVIAGIGNGFITATVPMLQAECARPERRGALVMLEGALVTGGIALSYWIDFGFYFVKTNDADWRFPVAFQCVFSMFLTFTVMSLPESPRWLVKKGRYEEAAGVFAALEDVALDDPYVIDQVTRVKESIIMGQLAQHGIEGEEAQRKMAAGECQMGDELPFWQQIKLLFTFGKKKHFHRTMLAYWIQVMHQVSGINLITYYAAYIYQTSIGMNAMNSRILAACNGTEYFLASWVAFYTIERFGRRKLMLFGTIGQACTMAILTGCVYASSTPADGGLGNEGAGIAAAVFLFVFNSFFAIGWLGMSWLYPAEITSLEVRAPANGLATSGNWVFNFMVVMVTPVAFNSIKWRTYIIFACINAAMIPTIYFMYPETMGKSLEDIDMIFALSNPKTPWDVVGISRRMPSSIDNASPAPIILEKPSQENLEYAPSMSEGTINSVRIETA

SEQ ID NO: 43 - protein, 659 aa, Yarrowia lipolytica
MSSYPSEKGGTEGIDRVPSETNDASDNTSDNNGLHEKPSNEHAEGLPPGNALNADLDPENPLSRYTRDELLEIASGFAKENGMGDKEDIFRKGALVAQDPANFDNIDILDDNDRYWLRREITHKWDHPMKVYYIVICCSLAAAVQGMDETVINGANIIFPAQFGIKEEAGVVSQKTWLLGLVNSAPYLCCAVVSCWLTDPINRLLGRKWTIFWTCFWSGATCFWSGFVNNWWHLFIARFFLGFGIGPKSATVPVYAAECAPPTIRGAMVMMWQMWTAFGIMMGYVMDLAFYYVPDHGIEGLNWRLMLGSALIPALLVCVQVIWCPESPRWHLARGEISKAYECMRVIRNSEVQAARDLFYAHVLLLEEEELKRGKNRFFELFTVPRNRRASWASFIVMFMQQFCGINVIAYYSSNIFMESGFGEIQALLASFGFGAINFVFALPAVYTIDTFGRRALLLVTFPLMAIFLLFAGFCFWIDQDDPTNSPARVGCIALGIYLFSAVYSCGEGPVPFTYSAEAFPLYIRDLGMSFATATCWLFNFVLAVTWPSLLAAFTPQGAFGWYAAWNVVGFFLVLCFLPETKNLTLEELDKVFGVPTRVHMKYQFNAFKVNIQRHLFRQDIPKPPPLYAHEVGVGGTSHYQHKPHHTANLTPLHTAELA

SEQ ID NO: 44 - protein, 659 aa, Yarrowia lipolytica
MVFGREKDDSEGIEHVPSPQDNPSDQTSDIIALNEKASNEHDDLPTIPKPEGDAPVNSELDPDNPLIRYSRAELLEIATQFAVDNDLADKAEAFRKGALVAQDPSGFENIDILDDDDRYWLNREITNKWDHPMKVYYLVVCCSLAAAVQGMDETVINGANIIFPAQFGIKEDSGVVSRKSWLLGLVNSAPYLCCACISCWMTDPINKVLGRKWTVFWTCFWAGATCFWSGFVNTWWHLFIARFFLGFGIGPKSATVPVYAAECAPPRIRGAMVMMWQMWTAFGIMMGYVMDLAFYYVKDRGTIVGLNWRLMLGSALIPALLVCIFIVKCPESPRWHLARGEIRKSFECMREIRHTDIQAARDTFYAHVLLIEENEMKKGKNRFVELFTVPRNRRAAWASFIVMFMQQFCGINVIAYYSSNIFMESGFGAIQALLASFGFGAINFVFALPAVYTIDTFGRRALLLATFPLMAIFLLFAGFCFYIGQNDPTHSHARVGLIALGIYLFSAVYSCGEGPVPFTYSAEAFPLYVRDLGMSFATAVCWLFNFVLAVTWPSLLAAFTPQGAFGWYAAWNVVGFFLVLCFLPETKNLTLEELDKVFSVPTRVHMKYQFNAFKINIQRTILRKDVPKPPPLYAHEAGIGGTSHWSSKPQPNANTAEFV

SEQ ID NO: 45 - protein, 505 aa, Yarrowia lipolytica
MSIKSLSKGSSLDDTCVGISRVATPTNLEKDLSLWETMKIYKKATFWSFVMCCTIIMDGYDGNMVPSFYALPVFQKKFGIQLPNGDWTVEAKWQTAFLVGVPIGRITGAVGVGLLADRFGRKKVTITSLAFMVGVTFVVFFATGKEMLCAGWIISGIIWGVFNTMAPTYVSEVCPIKMRSLLAAAINLSWVAGQFISTGVVTGTSTRTDDWAYRVPLAVQWVFPAILIPTLCFAPESPWWLLRRGEIDKARNALARLADETKIDLDAHLEHMIQTDKEEDKSGTIAECFKGPDLHRTEICSMVYSIQPLSGANIINFFAFFFQLTGVPQDIIFKLTLGLTGLGFLATLLSSVPIARVGRRKIMLTGLFVLTVALFAMGILGCFTSRGTNWATAILLFVWVGTYDLSIGPGAFVIYSESSSVRLRSKTIAIASVISSTVTLVFNVAVPYMLNEAEANMRGLVGFVYGPLCILSLIWVYFRLPELKGLSYMEIDRLFEGKKVAKDGV

SEQ ID NO: 46 - protein, 539 aa, Yarrowia lipolytica
MFWKNMKNEPKQVLNWTLWLSVLVFGLLGSARGLDEGNISGTSHQVSFENQFGLRDPNKTEKEIADALSNITAMVQLGSVGGSIIAMFAQDKIGRVRCLQQMLIVWIVGVVIQVTSHGQGQLLAGRFIAGLGIGQSVVIGPTYLAEVSPKNVRGLCTCVFSGSVYLGIMLEYFANYSTTLNVSDESRMQWVLPTSVQFIFAGLLFIGSFFIYESPRWLMKIGQEEKAMETLSKIRHLPIDDVYIQGEILDVREQVEREKQALSGTSIFSILKELVATQANRYRLFIGIMVQLLGQWSGANAVTIYSPQFFAMLGVTLRTDRMMYTAILGIIKFAASVVCAVFLIDTIGRRRSLYTGVCLQFISMLYLGIYLSIVPASSGAVEDRTASQRHAGGGAIAAIYLSGCGWALGWNSIQYLINAEIYTVRHRSLACGIIMVFHFVNQYGNSKALPYMRKSLTDHGTMFFFSGVILIGLAWSWFFLPEVSGRSLESIDEMFSLPWYLIGRRGAKLVPETSTTTQLQEDDDLAKEKKGATVHVETC

SEQ ID NO: 47 - protein, 533 aa, Yarrowia lipolytica
MFWKNMKNEPRQVLNSTLWLSVIVFGLLGSARGLDEGMIAGTTSQASFEHQFNLKDPTKTANQQANELSNITAMVQIGSVGGALIAMFVQDRIGRIRCLQEMIILWTVGVIIEVTSYSQGQLLAGRFVAGLGIGQSVVVGPTYLAEVAPKNVRGLCTCIFSGSVYLGVMLEYFANYSTTLHMSPNSRIQWVLPTAVQFIFAGLLFIGSFFIKESPRWLMKIGKDELAVETLSKIRHLPVDDLYVQGEIVDVREQIEREKQALSGTSILSLLKELVSTKANRYRLFLGIMVQLLGQWSGANAVTVYSPKFFSMLGIPSKTDQMMYTAVLGVIKFTSAICCALFLIDTIGRRRSLYTGICLQFVSMLYLGIYLAIVPATVGVDRSPSQKKAGGAAIAAIYLSGCGWALGWNSIQYLINAEIYTVRHRSLASGIIMVFHFANQYGNSKALPFMRSGITDHGSMFFFAGVLLLGLAWSWFFLPEVSGRSLESIDEMFSLPWYQIGRRGHKLVPETGTVIQIQEEEEKKGGVIHVENC

SEQ ID NO: 48 - protein, 566 aa, Yarrowia lipolytica
MSGQTYIEGWPGVEPVLFLLSLSTLSLSPPAMFWISMKNEPKQVLNRTLWFAIFVFGLLGTSRGLDEGNISGTVAQPSFISKFKLHDPSLSKDAQANLLSNITSMVQIGSVAGALIAMLIVDRIGRLWALREMLVIWIVGVIVQITSNNVGQLYAGRFVAGMGIGQSVVIGPTYLAEIAPPHVRGLATCVFSGSVYLGVMLSYFANYGTTLHISNTSRNQWVIPTTLQIIFSGIMLIGSIFVHESPRWLMKIGKEEEAVETLCKIRKLPADDLYVQGEILMVREQIEREKQAMTGASYWSLFKELLATPANRYRLFLGLMIQILGQWSGANAITIYAPSFFQMIGVSGQQQKMFATAILGVVKFAASIICAVFLIDTIGRRRSLYSGITLQFISILYVAIYLAVVPNNDPSRIKSAAERHAGVGAIAFIYLSGVGWALGWNSIQYLINAEIYTVRHRSLASGLIMTVHFANQYGNSKALPSMRLGMTDTGAMFFFSGIILVGLVWSWFFLPEVSGRSLESIDEMFSLPWYLIGRRGHQMVPETSAAVQIAADEDEKKGGVVHVENC

SEQ ID NO: 49 - protein, 536 aa, Yarrowia lipolytica
MFWKNMKNEPPQVLNWTLWLAVIVFGSLGSVRGLDEGLISGITSQASFESQFKLKDPLKSKSQQDDELSNITAMVQIGSVGGAMIAMLIQDKIGRIRSLQEMLILWTVGVIIEVTSYSQGQMLAGRLIAGLGIGQSVVIGPTYLAEVSPKNVRGLCTCIFSGSVYLGVMLEYFANYSTSMHMPATSRNQWVVPVSIQFIFAGLLFIGSFFVHESPRWLMKIGKDEEAIETLSKIRNLPADDLYVQGEIMDVREQIEREKQALSGTNIFSLMKELVSTKANRYRLFLGIMVQLLGQWSGANAVTVYSPKFFSMLGIPSKIDQMMYTAILGVIKLVSALSCALFLIDTIGRRRSLYTGICLQFVSMLYLGIYLAIVPAKTGVERTPSQRHAGAAAIAAIYLSGCGWALGWNSIQYLINAEIYTVRHRSLASGIIMTFHFANQYGNSKALPYMRAGITDHGTMFFFAGVLLLGFAWSWFFLPEVSGRSLESIDEMFSLPWYVIGRRGHKMIPETSATVHLRQEEDSESKKGGVVMVESC

SEQ ID NO: 50 - protein, 579 aa, Yarrowia lipolytica
MSHRPWDCLPLWNTVVVFRRCVLWSLVMCFVIVMDGYDGFLIPSFYAVPSFQRRYGVQLPDGSWTVEAKWQTAYMVGAPIGRIAGALGVGVLADRFGRKRVTLVGLFCLSGITFIVFFAVGKAMLVVGWFLSGLIWGIFNTMTPTYVSEICPVSLRSTFAAAINLSWVVGQFISTAVITASESRQDEWAYRVPLAVQWVFPVVLIPLVMVMPESPWWILKHGDKKGARQVLTRLMDEKDVDIDMYLEYMRQTLEDEVDGGSFVDCFKGSDVRRTEICCLTYFFQPLSGLYILSYAAYFLQLTGIPQNVVFKLTLGLTGLAVMASLVAPIVILTFTRRSIYMGSLALMAATLFAIGITACYDTQAAKWAAPVLIYVWVGTYDATIGPLTYVIVSETSSVKLRSKTIALASITNSIMVLVLHISVPYMMNEEEANMDGFVGFIYAPFCLLAIAWAWWRLPELKGMSFMEIDMLFGNETGTQRAPLVFDGQKRERQPLESLDGLGWRFGGQQDLSETNDNNEGSREERLSNPYCSSNEDNRSDRFQPSERGCILDSPKRKHAIEKNGVVITETLEMGENADR

SEQ ID NO: 51 - protein, 476 aa, Yarrowia lipolytica
MSSISSSQQPNFKSILQYNARQEMIYWMAFVACLGTLQFGYHVAELNAPLDVIICHDAVTDCIDLHPRDVGYVTAAFSVGGLISALLAGMAASKYGPKKVSLFNTLSFIAGPLFMANATNTNTLAFGRFVSGLGAGAAIVVTPLFLNEIAPHNLRGMFGALSQISVNVGIVAAQVAGLIISQSWRYILIIGFFLGLINLASLAFIPESPKWLVSKNRATEATAILARLRDNRATAAREVEEWQKELQSVMFESDQLMAPASAASANHIEPVSLSAFLTRKPYRKPLLAILIIMTAQQLCGINSIIFYGVSILGQIIPKYSTLVNVFISVLGTVVTVGASRFIDVLGRKRLLLYSIFGMSVSAALVATGIINSWPIVSSLSAALFVVSFAIGLGPIPFLMVSEMVEPNCVGVGQSVGMTSNWIVTFAVGYFFPMVNARLGGATFYLFSVFGIAYLTLVVKFVPETKGKRNFTEVWTM

SEQ ID NO: 52 - protein, 577 aa, Yarrowia lipolytica
MADNNVTEGGNAAFHNYVNDFAHIEDPNERRRLALEKIDNASFGWEHIRAITVAGVGFMTDAYDIFAINLGITMMGYVYWGQTINGPGKPPTSTATLLKVSTSVGTVIGQFGFGILADIVGRKRIYGSELMLMIGATISQCMAGHSEAINFVAVLTFWRIVMGIGIGGDYPLSSIITSEFATTRWRGAMMAAVFANQGWGQLMGAIVSIVCMAGFKNQLEPSHSAKDCGKVCRQALDMSWRILVGWGCVPAMAALYFRLTIPETPRYTFDVSRDIEKAQKDIEKYTNGDTSGDNSDKNDEIEALRAKAEALATQQASYAPPKASFKDFCRHFGQWKHGKILIGTAGSWFFLDIAFYGLGLNNSQILKAIHFDKGDNLYSTLMKNSIGNLILVCAGAIPGYWISVVTIDTIGRKPIQIGGFLILVALFCIIGFGYYKIHDGGLLACYILCQLFENFGPNTTTFIVPGEVFPTRYRSSAHGISAAAGKIGAIIAQVVIGTLIDHNCARDGKPAGCWLNHVMEIFALFMLCGFFVSFLIPETKRKTLEQLSEELHGEIQWRPPHEMEHSSHDFNEEEKSV

SEQ ID NO: 53 - protein, 575 aa, Yarrowia lipolytica
MDAQNKTAGGNAAFHNFVNDFAHIEDPNERRRLALEKIDSASFGWYHIRAIMVAGIGFMTDSYDIFAINLGITMMSYVYWGQGTGHDGHIPDSTNTLLKVSTSVGTVIGQLGFGILADVVGRKKIYGVELILMIGATIAQCMTGHSQAISFVAVLTFWRIVMGIGIGGDYPLSSIITSEFATTKWRGAMMGAVFANQGWGQLMGSIVAICCVAGFKNSLEPYHGANDCGFDCQQALDKSWRILVGWGCVPAMCALYFRLTIPETPRYTFDVSRDIEKAQADIDKYTSGEHGNASPEEIEALKAQAEELQTQQNAYNPPVASAGDFFRHFSQWKHGKILLGTAGSWFLLDVAFYGLGLNNSTILHTIGFDKGDNLYSTLMKNSVGNLILICAGAIPGYWLSVVTVDFIGRKPIQIGGFTILTALFCIIGFGYDKIGEGGLLACYILCQLFENFGPNVTTFIVPGECYPTRYRSSAHGISAASGKVGAIIAQVVIGTLVNHNCDRDGKPKGCWLNHVMEIFALFMLLGIGTSFLIPETKRRTLEDLAEELHGEVQWRPPVEDQAEDVSDFNDNEKSV

SEQ ID NO: 54 - protein, 581 aa, Yarrowia lipolytica
MDGSTDAPIHHPTPPAMSWKRHFNGSVIRDELYFPWSARDKARDQQSKDPVYQDAEAAEGLPGTHYDAHVEDVNEDGTPRTVWGKNGKAWPVMTAGAGLFSDGYVNNSMGTVTTVLKRIYGKEYSASRKSQILPAIVFVGTVVGMLVFGYVADYHSRKLGMVISTMILIIFTILCSGSWGAGGKKNMDGMLAALITYRFFMGIGLGGEYPAGSVACAEASAIMGRGTRNRWFILFTNFMIDFGFVCSAFVPCVLWWIFHDRHLQAVWRLTLGLGAIPPLGLFYLRTKFKENPSFMKNNFKRTRFPYWLAIKYYGVRLACVSLIWFIYDWASYSYGLYASSILDNLNPNQSLIKNFGYTTIINLWYLPGSFLGAICADYLGPRLTLIIGVVAQAVVGYIMAGIYTHLSKPENVAGFICMYGVFLALGEFGPGDQIGLIASKTCATPIRGQYYAIAAAIGKIGAFVGTYCFPAIQKSVGHGDPDSVEGQQGPFWVSCSMNILSAVLAYFLLPSITQETIQDEDRLFREYLVGHGFDVTLMGDAEFADGANASSEDQTEFKEGHEPQHSSDEQEHLPSKLEAIQ

SEQ ID NO: 55 - protein, 502 aa, Yarrowia lipolytica
MNFDNFPAPDLSPKNIKRYLVTRVTSLKPPKLTVEEKKHINPIPALRLLNRKQWLFVAVGFCGWAWDSFDFFSVSLVASEIAESLHVSVTSITWGITLVLMLRSVGAVIFGMLSDRFGRKWPFITNCVLFIVLELGTGFVQTYKQFLAVRALFGIAMGGIYGMAAATALEDCPVQARGVISGLLQEGYAFGYLLCVVFTRAIADTSPFGWRALFWFGSGPPVLIIIFRLCLPETDTYLLSKKNAAEAEGIEKNFWRGIKMTFKTYWLMFAYLVVLMGGFNFMSHGSQDLYPTMLKKQLGFSEDRSTVTNCVANFGAIAGGLVVGHASSFFGRRLCIMISCVIGGALIYPWAFVTNSGINAGVFFLQFFVQGAWGVIPIHLTELAPPVLRSSMVGVAYQLGNLASSASSTIEATIGETFPLYDKFGNEKPGVYNYSLVMAILMGCVFFFVLCVTFLGPENRQAEMISGGSEQDNAYERKLEEMEDEEKGVTENIERRSSSDTR

SEQ ID NO: 56 - protein, 536 aa, Yarrowia lipolytica
MAASTSSSIPDNVEKSASVEKSASAEDYEMVHAPVEENPEFVVDDVKRNRRQRIADGFTVLAAGFALISDGYQNSMMTMMNVTFQERYGKEVYNSTVSTRVSNALLVGEVIGMIVIGLTCDYMGRKTAIVVTTILIVLGGIMATASHGVTTDGMFWMLVVSRGVIGFGSGGEYPAASTSASEAANEKHLRKRRGAIFVLCTNLPLSFGNPFCVIVFLIVYAACGFKGQHLSTVWRTCMGIGCIWPLTVFYFRLKMAQPRLYTKSAIKKSVPYWLILKFYWRTIIGTAGTWFIYDFVVFPNGVFSGSIIATIIKPDEPDKLLKTAEWQLLIGAIGLPGVFIGAWLCENRVLGRKYTMLIGFALWIVVGLIIGCAYTPLKRSTGAFVFMYGMLSSSGNLGPGNMLGLVSSEAYATAVRGTLYGFSAAVGKAGAAVGTQVFKPIQGNLGDRWTFIIAAILGLCGVIVTLFFVPRLNGEDLEEEDVRFKQFLRAHGWEGEFGTVADKVDDIEETTSDEAHDTDGIETQQIITETPNKMSN

SEQ ID NO: 57 - protein, 529 aa, Yarrowia lipolytica
MPITVSQEVTETAPEVSWAATKTYLGSRVSTLKPPKLSAQEKRCLNPIYVLRQLGKKQWLFFSVAILGWIWDAFDYFSVSQTATEIAKDLDMSVADITWGLSIVLMLRSIGAIIFGLASDRFGRKWPFIVNIAIFSILELGTGFVQTYTQFLALRALFGIAMGGMFGNAAATALEDCPPEARGLISGFLQAGYDIGNLLCVIFTRAIVPNSKHGWRALFWFGAGPPILIMVFRAFLPETDTYIASRINKEDNSTVEIDPETGLHMQPAQKVGTWASIVIFIKGVGHTLKVHWLMFTYLVVMMAGFNFMAHGSQDLYPTLLKNQLKFSIDRSTVTNAVATLGALSGQVTIGHLSNVFGRRLSVIISCVIGGALIYPWAFSGGGAGINASVFFLQFFVGCWGIVPIHLSELTPPALRTSLVGVAYQLGNLASAASSTIEAKIGERFPILDEHGNHLPEEYDYGKVMAIFMGCVFAFTMIVMFLGPEKRGSDLCAPQYEVTDAQTAAGDEKFEDKEKVEEVAIERIDTNLTR

SEQ ID NO: 58 - protein, 499 aa, Yarrowia lipolytica
MDLDNLPAPDLSWKSIKHYLATRVTTLKPPKLSAEEKKHINPIPALRTLNKKQWLFVLCGLAGWTWDSFDFFSVSLVASDIAKDLNVSVTDITWGITLVLMLRSVGAIIFGVASDRYGRKWPFIFNCVLFIVLELGTGFVQTYKQFLGVRALFGIAMGGIYGNAAATALEDCPPEARGVISGLLQEGYALGYLLCVIFTRAIADTSPHGWRALFWFGSGPPVLIIIFRFFLPETDTYIQSKQNAEALGVEKHFWLGIKTTFKTYWLMFIYLVVLMAGFNFMSHGSQDLYPTMLKVQLGFSPDRSTVTNCVANLGAIAGGVIIGHFSSVLGRRLSIMISCILGGAMIYPWAFVTNSGINAGVFFLQFFVQGAWGVIPIHLTELCPPALRSSLVGLAYQLGNLASSASSTIEAQIGTQFPIKDDNGVDRPGVYNYSLVMCIFIACVFTFVFVVTFLGPENRMAEMVAHEHVEYTKEMSDDEEKGVQETVEVVERVDTNATK

SEQ ID NO: 59 - protein, 524 aa, Yarrowia lipolytica
MEAPNLSPASIRRYFATRLPTLIPQKLTPEEKKLLNPFPALALINKKTWLFIACAFCGWTWDAFDFFSVGLVAPEIAKSLNRSVTDITWGITLVLMLRSIGAVVFGIASDRYGRKWPFIVNLLCFIALELGSGFVQTYKQFLGVRAIYGIAMGGLYGNAAATALEDCPPQARGIISGFLQSGYALGYLLCVVFTRAIADTSPYGWRALFWFGSGPPVLFIIFRYFLPETETYLASKASQEEAGIEKKFWNGIKVTFKNYWLMFIYLVILMAGFNFMSHGSQDLYPTMLKNQRHFSADRSTVTNCVANFGAIAGGMLIGHFSTALGRRLSIMISCVIGGALIYPWAFVGNSAGTNAGVFFLQFFVQGAWGVVPIHLSELSPPELRSSMVGIAYQMGNLASSASSTIESKIGERFPLKNAKGEFEKGFYDYGKVMAIFMGCVFGFVLIVTFVGPENRGATMLTEDAQMMVDAEHRLDAEEKGDFENLERVDSEGKQMDNFVEEVAEPEGVYTGSHPPQYDSPYESK

SEQ ID NO: 60 - protein, 523 aa, Yarrowia lipolytica
MDLDNYPPPDLSWSNIKHYLGTRISTLKPPKLTEAEKKHMNPIPALRLLNKKQWLFVGVALAGWTWDAFDFFSVGVVATQIAEDLNVTVKDVTWGITLVLMLRAVGAVLFGVASDRYGRKWPFIFNNFLFVVLELGTGFVQTYQQFLGVRALFGIAMGGLYGNAAATALEDCPPEARGFISGLFQKGYGVGYLLCVVFARAIADTSPYGWRALFWFGACPPVLIMIFRFFLPETDTYIQSKKNAEAEGVEKQFWQGVKTTFKSYWLMFFYLVLFMTGFNFLSHGSQDLYPTMLRAQLGFDKDQFTITNSVASLGSIFGGMVIGHASFILGRRLTILLACILGAACIYPWAFVTGPGINAGVFFLQFFAQGAWGVVPIHLTELSPPALRSSMIGIAYQLGNLASSGSSTIQATIGTQFPLRDENGKIRPGVYNYSLVMAIFIACVFVFLFVVTLLGPERRHAEMIAGGAGHRSESDEKIYDEEKGAAVNVEQVESPASTPERSASPLPTTEVNHTSETLPGSQK

SEQ ID NO: 61 - protein, 608 aa, Yarrowia lipolytica
MGAKDETISPTTFSNLSDSSNTRSGTDNSPENDIIDGAHEKDAATTDVTPDTDAVARPTGPPPISNAKKGLIAGLLSLSVLIVALDQTIVTTSLPDIVAALKSSSGYSWVGAAYTLACAGVLPAYGRFADIFGRKITLMVAILLFILGSGICGGASSINMLIGGRVVQGLGGGGISALVNIIISDIVALHQRGAFMGMLGATWAIGGAIGPLIGGALTQNVSWRWCFYLNLPIAGFTMCMLFLLLKNNKGLEYENDTRTVWQKLLKIDFCGIILVAGATVLLLLALDWGGTTHPWGSGIIIAFLVVAFVLYGIFLTLEWFQDQRENYPRPIMPPSLFANKTRLGGYLFTFFHSIVFMCISYFMPFMYQSVYGKSPMGSAVYLLPQAFVTGGLSAGAGIFIAKTGHYLPVMWISSVIIIVFTGMLSTLDETSNVGKRICYVMAWGAGIGPVFQAPLVVIHTQVERKNIAISTTTWSFVRMLGMSIGISIGGVVFQNQMEDQISDPAIIRQLPEWLLEPLSGTNAAAATQMLNNKGSDISAHVLSLVRYMYSHAFKYVFYTCLGLCGGLLSVLLIGKHQVKMRGDLGKKEKQEKREAENRALSEQPGESV

SEQ ID NO: 62 - protein, 503 aa, Yarrowia lipolytica
MTQSYEVGNLPPPDLSWRSVKRYLASRVTTLKPQPLSDSQKRLLNPIPTLRLLTFKQWMFVLVAFWGWTWDAFDFFSVSLVASEIAETLQVSVTDITWGITLVLMLRSIGAVVFGVLSDKYGRKWPFISNLVLFIVLELGTGFVTTYKQFLAVRALFGIAMGGIYGMAAATALEDCPVDARGLVSGILQEGYALGYLLCVVFTRALVYTTPHGWRSLFWFGAGPPVLIIIFRMALPETDTYIQSKHNEAVLDTGKNFFVGLKTTFSTYWLTFIYLVILMSGFNFMSHGSQDLYPTRLKNQLEFSPDASTVTNCVANLGAIAGGIFMGHISSFAGRRLCIMISCVVGGALIYPWAFVSSNAGINAGVFFLQFCVAGAWGIIPIHLTELAPPALRSSLVGLAYQLGNLASSASSTIEAKIGERFPLTDAHGNARPGVYDYSLVMAILMGCVFFFVLVCTFLGPENRNAEMVVGELVGPETKLVEDEAMEVYGERRSEQTTVGSVH

SEQ ID NO: 63 - protein, 644 aa, Yarrowia lipolytica
MQESQEYLDLDPGSEKIGDTPSPDIARDLEEQAEKAAESAVDGQRADSLHRHNSYPIPPLAGLTLQRTLTHRSRVSRLSHHSEEQSGDQSGNAMNSETPALPGHVTQDHLSQTRRYLICFMLCVCTLLVAIDETIITTALPEIVAALKSSSGYTWIGTSYLLACASSMPAYGALADIFGRKPIILLSIALFLIGSAIAGAATDMGMMISGRVIQGIGGGGISNLVNVIVADIIDLKYRGTFMGAIGATWAVGGCMGPLLGGAFASGGQWRWCFFLNLPIAGVCFIFMAWLANIKSPPTTLRDGLKRIDFLGIILITCATVCLFLALDWGGVHFAWNSAPVIVCLVLSGVLYIAFVLCEKYIPNEPVMPPRLFTNFSRTGALLCTFFHSTTFMAVSYFTPFMYQSVYNKSPIGAAVYLLPQAIVMGLASAISGYIITKTGKYKIIMIVGFSLAAIFNGMIVTLNPDSNTAKQIMWVTVWGIGIGPNFESTLIALHTHIKSQDIATATSTWGFLRTIGFSIGIAIGGVVFQNKMQTENEELGHLLPADLRELLTGADAAASTTLIKNYSEPVQKVAKLMYSRSFKDMFWTCLGLCLGYLFVFLIKERPLEMKDAKGETTETEDEVDQIVDVIVDDFEGNQKHRDGA

SEQ ID NO: 64 - protein, 531 aa, Yarrowia lipolytica
MPQIFFNKVYPGEMALPGRTKTAEELEALEAEKNDPQMQRPMFGKNGRAWPVITAGAGLFSDGYVNNSMGTVNTCLSILYGDYYSKSTYSRTVSSIVFAGTVLGMIVFGFVADYHSRKMGMIASTLILIVFTILCSAAWGAGGKDDIGGMLSALIAYRFLVGIGIGGEYPAGSVACSEASALMGNGTRNRWFIFFTGFMIDFGFVVAAFVPLILLWICGDDNLTPVWRITIGLGAIPPLSLFYFRTRFKEPDTFRKNNFKRTRPPYILALRYYGPRLVVICIVWMLYNFISFPFGIYGSQIINLLVKDGDLYKTFGWNVLLTAFYLPGAFLGAIFSDWFGPRITLAGALILQGIVGFIMAGVYESMIKNIAGFVIAYGIFQALGEMGPGGNIGLLASKNSPTAIRGVFYCIASSMGKIGAFIGTQCFPLIIKGFEKGGDEIKGVQGPFWISSALCIFSALITFFFLPPVTQTSVQDEDRKFFEYIRAHGFDVSKMGDEGFEPESEESMETELYEQKGSNEELYVNTHEVKN

SEQ ID NO: 65 - protein, 579 aa, Neurospora crassa
MSSHGSHDGASTEKHLATHDIAPTHDAIKIVPKGHGQTATKPGAQEKEVRNAALFAAIKESNIKPWSKESIHLYFAIFVAFCCACANGYDGSLMTGIIAMDKFQNQFHTGDTGPKVSVIFSLYTVGAMVGAPFAAILSDRFGRKKGMFIGGIFIIVGSIIVASSSKLAQFVVGRFVLGLGIAIMTVAAPAYSIEIAPPHWRGRCTGFYNCGWFGGSIPAACITYGCYFIKSNWSWRIPLILQAFTCLIVMSSVFFLPESPRFLFANGRDAEAVAFLVKYHGNGDPNSKLVLLETEEMRDGIRTDGVDKVWWDYRPLFMTHSGRWRMAQVLMISIFGQFSGNGLGYFNTVIFKNIGVTSTSQQLAYNILNSVISAIGALTAVSMTDRMPRRAVLIIGTFMCAAALATNSGLSATLDKQTQRGTQINLNQGMNEQDAKDNAYLHVDSNYAKGALAAYFLFNVIFSFTYTPLQGVIPTEALETTIRGKGLALSGFIVNAMGFINQFAGPIALHNIGYKYIFVFVGWDLIETVAWYFFGVESQGRTLEQLEWVYDQPNPVKASLKVEKVVVQADGHVSEAIVA

SEQ ID NO: 66 - protein, 525 aa, Neurospora crassa
MGIFNKKPVAQAVDLNQIQEEAPQFERVDWKKDPGLRKLYFYAFILCIASATTGYDGMFFNSVQNFETWIKYFGDPRGSELGLLGALYQIGSIGSIPFVPLLTDNFGRKTPIIIGCVIMIVGAVLQATAKNLDTFMGGRTMLGFGNSLAQIASPMLLTELAHPQHRARLTTIYNCLWNVGALVVSWLAFGTNYINNDWSWRIPALLQAFPSIIQLLGIWWVPESPRFLIAKDKHDEALHILAKYHANGDPNHPTVQFEFREIKETIRLEMESTKNSSYLDFFKSRGNRYRLAILLSLGFFSQWSGNAIISNYSSKLYETAGVTDSTAKLGLSAGQTGLALIVSVTMALLVDKLGRRLAFLASTGGMCGTFVIWTLTAGLYGEHRLKGADKAMIFFIWVFGIFYSLAWSGLLVGYAIEILPYRLRGKGLMVMNMSVQCALTLNTYANPVAFDYFGPDHSWKLYLIYTCWIAAEFVFVFFMYVETKGPTLEELAKVIDGDEADVAHIDIHQVEKEVEIHEHEGKSVA

SEQ ID NO: 67 - protein, 639 aa, Lactobacillus acidophilus
MANGHKTSGKQIISYASFCLGNLGHAAFYGVMSTYFIIFITSGMFSGLEQSVADKLIGLITGLMVLIRIVELVIDPILGNIVDNTKTKWGKFKPWIFIGTMVSAVLLLILFTGIFGLAQSNWILFAILFVIIYIGFDVFYSLSDVSYWGMVPALSEDSHERGIYTSLGAFSGAIGWNGLAIIVVPLVTGVTYAVTGKNEEGAPGWLAFAAVISALAIICAIIVCFGTKEKHNLIRNSAKQKTTLRQVFSAIFHNDQILWPSLAYLVFSLANTITNGVLFYLYKFVIGKPGEFWVVGLIATIIGFCVSPMFPILNKYIPRKWLFIAGQTCMICAYLLFIFCRDNVVLMDLGLILFNINFAQLVTVLTLTDAIEYGQLKSGQRNEAVVLAVRPMIDKFTGAVSNALVGYVAIAAGMTGTATAADMTAHDISTFNTMALYIPLVLPAISIVVFMTKVNLSEKKHAQVVEELKDKLAEGKLEKADTEAARPKEVTIYAPADGKLMNMSSVIDEDGRPFPGKGFAIKPSTGKIYAPFDGEIKFTFGTKHAFEIISNDGLQVIVHVGLGTVNLRGQGFETYYDDGQHVKKGDLLLEFDRDLALNNGYKDTIVTFYTQPRRIQETSEIQAGTTVEHGEKVVEVKFR

SEQ ID NO: 68 - protein, 634 aa, Streptococcus thermophilus
MEKSKGQMKSRLSYAAGAFGNDVFYATLSTYFIMFVTTHLFNTGDPKQNSHYVLLITNIISILRILEVFIDPLIGNMIDNTNTKYGKFKPWVVGGGIISSITLLLLFTDLGGLNKTNPFLYLVLFGIIYLVMDVFYSIKDIGFWSMIPALSLDSHEREKMATFARIGSTIGANIVGVAIMPIVLFFSMTNNSGSGDKSGWFWFAFIVALIGVITSIAVGIGTREVESKIRDNNEKTSLKQVFKVLGQNDQLMWLSLGYWFYGLGINTLNALQLYYFTFILGDSGKYSILYGLNTVVGLVSVSLFPTLADKFNRKRLFYGCIAVMLGGIGIFSIAGTSLPIILTAAELFFIPQPLVFLVVFMIISDSVEYGQWKTGHRDESLTLSVRPLIDKLGGAMSNWLVSTFAVAAGMTTGASASTITTHQQFIFKLGMFAFPAATMLIGAFIVARKITLTEARHAKIVEELEHRFSVATSENEVKANVVSLVTPTTGYLVDLSSVNDEHFASGSMGKGFAIKPTDGAVFAPISGTIRQILPTRHAVGIESEDGVIVLIHVGIGTVKLNGEGFISYVEQGDRVEVGQKLLEFWSPIIEKNGLDDTVLVTVTNSEKFSAFHLEQKVGEKVEALSEVITFKKGE

SEQ ID NO: 69 - protein, 634 aa, Streptococcus salivarius
MGKSKGQMKSRLSYSAGAFGNDVFYATLSTYFIMFVTTHLFNTGDPKQNSHYVLLITNIIAILRILEVFIDPLIGNMIDNTHTKYGKFKPWVVGGGIISSIALLLLFTDLGGLNKTNPFLYLVLFGIIYLVMDVFYSIKDIGFWSMIPALSLDSHEREKMATFARIGSTIGANIVGVAIMPIVLFFSMTNSSGSGDKSGWFWFAFIVALIGVITSIAVGIGTREVESKLRDNKEKTSLKQVFKVLGKNDQLMWLSLGYWFYGLGINTLNALQLFYFTFILGDPGKYSILYGLNTVVGLVSVSLFPSLAGKFNRKRLFYGCIAVMLGGIGIFSIAGTSLPMILTAAELFFIPQPLVFLVILMIISDSVEYGQWKLGHRDESLTLSVRPLVDKLGGAMSNWLVSTIAVAAGMTTGASASTITTHQQSIFKLSMFGFPAAAMLIGAFIIARKITLTEARHAEIVEELEHRFSVATSENEVKANVVSLVNPTTGHLVDLSSVNDEHFASGSMGKGFAIKPTDGAVFAPISGTIRQVLPTRHAVGIESEDGVIVLIHVGIGTVKLKGEGFISYVEQGDRVEVGQKLLEFWSPIIEKNGLDGTVLVTVTNSEKFSAFHLEQEVGEKVEALSEVITFKKGE

SEQ ID NO: 70 - protein, 634 aa, Streptococcus vestibularis
MGKSKGQMKSRLSYTAGAFGNDVFYATLSTYFIMFVTTHLFNTGDPKQNSHYVLLITNIIAILRILEVFIDPLIGNMIDNTHTKYGKFKPWVVGGGIISSIALLLLFTDLGGLNKTNPFLYLVLFGIIYLVMDVFYSIKDIGFWSMIPALSLDSHEREKMATFARIGSTIGANIVGVAIMPIVLFFSMTNSSGSGDKSGWFWFAFIVALIGVITSIAVGVGTREVESKLRDNKEKTSLKQVFKVLGKNDQLMWLSLGYWFYGLGINTLNALQLYYFTFILGDSGKYSILYGLNTVVGLVSVSLFPSLAGKFNRKRLFYGCIAVMLGGIGIFSIAGTSLPIILTAAELFFIPQPLVFLVILMIISDSVEYGQWKLGHRDESLTLSVRPLVDKLGGAMSNWLVSTIAVAAGMTTGASASTITTHQQSIFKLSMFGFPAAAMLIGAFIIARKITLTEARHAEIVEELEHRFSAATSENEVSANIVSLVNPTTGKLVDLSSVSDKHFASGSLGKGFAIKPSDGKVFAPISGTVRQILPTRHAIGIESDDGVVVLVHIGIGTVKLKGEGFISYVEQGDRVEVGQKLLEFWSPIIEQNGLDDTVLVTVTNSEKFSAFHLEQTVGEEVKALSEVVTFKKGE

SEQ ID NO: 71 - protein, 634 aa, Streptococcus infantarius
MRKSNVQMKSRLSYAAGAFGNDVFYATLSTYFIMFVTTHLFNTGDPKQNSHYVLLITNIISILRILEVFIDPLIGNMIDNTHTKYGKFKPWVVGGGIISSITLLLLFTDLGGLNKTNPFLYLVLFGIIYLVMDVFYSIKDIGFWSMIPALSFDSHEREKMATFARIGSTIGANIVGVAIMPIVLFFSMTNSSGSGDKSGWFWFAFIVALIGVITSIAVGIGTREVESKLRDNNEKTSLKQVFKVLGKNDQLMWLSLGYWFYGLGINTLNALQLYYFTFILGDSGKYSILYGLNTVVGLVSVSLFPSLAGKFNRKRLFYGCIAVMIGGIGIFSIAGTSLPIILTAAELFFIPQPLVFLVILMIISDSVEYGQWKLGHRDESLTLSVRPLVDKLGGAMSNWLVSTIAVAAGMTTGASASTITTHQQSIFKLSMFGFPAATMLIGVFIIARKITLTEARHAEIVEELEYRFSAATSEKEVNANNVSLVNPTTGKLVDLSSVSDKRFASGSLGKGFAIKPSDGKVFAPISGTVRQILPTRHAIGIESDDGVVVLVHVGIGTVKLKGEGFISYVKQGERVEVGQKLLEFWLPIIEQNGLDDTVLVIVTNSEKFSSFQLEQTVGEEVEALSEVITFKKGE

SEQ ID NO: 72 - protein, 627 aa, Lactobacillus delbrueckii
MKKKHVSRLSYAAGAFGNDVFYATLSTYFIVFVTTHLFNASDHKMIFIITNLIAAIRIGEVLIDPLIGNAIDRTESRWGKFKPWVVGGGIISSLALLALFTDFGGLNQSNPVVYLVIFGIVYLIMDIFYSFKDTGFWAMIPALSLDSREREKTSTFARVGSTIGANLVGVVITPIVLFFSASKANPNGDKQGWFFFALIVAIVSILTSIAVGLGTHEVKSALRESKEKTTLKQVFKVLGQNDQLLWLAFAYWFYGLGVNTLNALQLYYFSYILGDAHGYSLLYTINTFVGLISVSFFPSLAKKFNRKRLFYACIAVMLLGIGVFSLASGSLALSLVGAELFFIPQPLTFLVVLMIISDAVEYGQLKTGHRDEALTLSVRPLVDKLGGALSNWFVSLIAVTAGMTTGATASTITAHGQMVFKLAMFAFPAVMLLIAVSIFAKKVLLTEEKHAEIVDQLEAQFGQSHAQKPAQAESFTLASPVSGQLMSLDMVDDPVFADKKLGDGFALVPADGKVYAPFAGTVRQLAKTRHSIVLENEHGVLVLIHIGLGTVKLNGTGFVSYVEEGSQVEAGQEILEFWDPVIKQAKLDDTVVVTVINSETFANSQLLLLIGHSVQALDDVFKLEGKN

SEQ ID NO: 73 - protein, 633 aa, Lactobacillus hamsteri
MKKKVISRLSYSFGAFGNDVFYATLSTYFIVFVTTHLFKSGASQMIFMITNLIAIIRISEVFIDPLIGNAIDRTVTPWGKFKPWVVAGGVISSLALLALFTDLGGLNKSNPFMYFVFFGIIYLVMDIFYSFKDTGFWSMIPALSLDSHEREKTATFARIGSTIGANIVGVVIMPIVLFFSQNKTNPNGDKQGWFWFAFIVAVIGIASAISVGIGTHEVKSKLRENKEKTTLSQVFKVLAKNDQLMWLALAYWFYGLGVNTLNALQLYYFSYILGNAHGYTILYGINTIVGLISVGLFPSLAKKFNRKRLFYICISVMLIGILVFFLANGSLAIVLTGAELFFIPQPLAFLVVLMIISDAVEYGQLKTGHRDEALTLSVRPLVDKLGGALSNWFVSLVAVMAGMTTGATASSITNHGQMIFKLCMFGFPASMLLISVIIFAKKVLLTEEKHAQIVNELEKRFSKKHARNPIIKKKKIKLNTPIAGTLLPLKDLPDSTFSYGLMGKGFVIIPVSGKVYAPFSGKIKQIAPTRHFIMLENEVGMVVLIHIGLDTVTLNGTGFTTLVDVDDHVVEGQEIMEFWDPVIKKHNLDDSAIITVINSEMFDDFKLIQEYGHKVNAMEAICLVESRSKKDDK

SEQ ID NO: 74 - protein, 638 aa, Streptococcus equinus
MDTKSNAVSKKQAATSRISYAFGAFGHDIFYATLSTYFITFITSHLFNTGDAAQNNRMVLYITQIIAGLRIVELVIDPFIGNMIDNTKTRWGKFKPWVVAGGTISSIALLILFTDMGGLNKTNPVLYLIIFAFIYITMDIFYSFKDIGFWSMVPALSFSSEEREKTATFARIGSTIGANIVGVVIMPIVLFFSLNRNGGAGDNRGWFWFAFIVALLGVLTVLAVAFGTHEIESDLRKNTEKTGFKDVLKVLTKNDQLMAISLSYVLYTTGISILNASELYYFTYILGHAAQFSILGTINTVVGLLSVSLFPKLAGKLNRRNLFFACIAVMLCGIGLFSVAGTSLALVLVAAELFFIPQPLVFLVVLMIITDCVEYGQWKLGHRDEALTLSVRPLLDKFGGAISNLVIGAAAVAAGMTTGATADSITKAGAMSFKLHVFALPFALIILSSVVFFFRVKLTEEKHAEIVEELERTWGHEYVDDEVETDGGLTISAPIAGELLDLSQVADPVFASEGLGKGFAIKPSDGCVYAPFDAMVRQVFTTRHAVGLVSEDGIVLLIHIGLGTVKLKGTGFVSYVVEGERVKKGDKLIEFWDPVIQKAGLDDTVIITVTNTHAFEAFNMQAKAGETVKAGDNVLTLH

SEQ ID NO: 75 - protein, 640 aa, Streptococcus infantarius
MNQTTHANKDLKKSAAISRISYAFGAFGHDIFYATLSTYFITFITSHLFNTGDAAQNNRMVLYITQIIAGLRIVELIIDPFIGNMIDNTKTRWGKFKPWVVAGGTISSLALLILFTDMGGLNKTNPVLYLIIFAFIYITMDIFYSFKDIGFWSMVPALSFSSEEREKTATFARIGSTIGANIVGVVIMPIVLFFSLHRNGGAGDNRGWFWFAFIVALLGVLTVLAVAFGTHEIESDLRKNTEKTGFKDVLKVLTKNDQLMAIALSYVLYTTGISILNASELYYFTYIMGHAAQFSILGTINTVVGLLSVSLFPQLAGKLNRRNLFFACIAVMLCGIGLFSVAGTSLALVLLAAELFFIPQPLVFLVVLMIITDCVEYGQWKLGHRDEALTLSVRPLLDKFGGAISNLVIGAAAVAAGMTTGATADSITKAGIISFKLHVFALPFALIILSSLVFFFRVKLTEEKHAEIVEELERTWGHEYIEDEVETDGGLNISAPISGQLIALSDVDDPIFAKEGLGKGFAIKPSDGCVYAPFDAMVRQVFTTRHAVGLVSEDGIVLLIHIGIGTVKLKGTGFVSYVVEGEHVKKGDKLIEFWDPAIKKAGLDDTVIITVTNSHVFNDFVMKAPAGTNVQAGDDVLTLN

SEQ ID NO: 76 - protein, 637 aa, Leuconostoc lactis
MPSNKHTMSSRLSYAFGAFGNDVFFATLSTYFIMFVTTHLFNTGNSAENDRMISYITLIIFVLRFVELIIDPFIGNAIDNTVTRWGKFKPWVVVGGTIGSIALIILFTNMGGINKSNPFLYLLLFGFVYITMDIFYSFKDIGFWSMIPALTLNSREREKTATLARIGSTIGGNLVGVVVMPLVLFFSMKSNGGTGDSRGWFWFAVIVATVAWISSIVVGLGTKEIDSTLRQNKERTTFKQVFHILTHNDQLMWIALAYGLYTTGVTLVNSLELYYFTFILGNSSAFSILAGLNIVTGLVAVALFPTLSDKLNRRKLFFWCIAIMLSGIILFSFAGGSLTLVLIAAELFALPQPLVFLVVLMLISDSVEYGQLKLNHRDESLTLSVRPLLDKLAGAISNGAVGLTAVAAGMTTGATASSITPSGQLTFKIIMFGLPFIIVSIGAFVFYRRVTLTEDKHAEIVDQLEKTWGKKFENSQSDLIDLDQAHTQYYAPIAGTLEPLATVSDPAFASGALGEGFAIKPTDGRVYAPFDGVIRSTFSTRHAVGIESDSGVVTLIHIGINTVSMQGTGFITYFDKGQRVKRGDLLIEFWDKAIKDAQLDDTVMVTITNANALPQLTFKKAFGSQVSKNDILLEFND

SEQ ID NO: 77 - protein, 643 aa, Leuconostoc pseudomesenteroides
MKSNKQSMTSRVSYAFGAFGNDMFFATLSTYFIMFVTTHLFNSGNAAQNDKMISYITLIIFLLRFVELAIDPFIGNAIDNTSTRWGKFKPWVVVGGTVGSIALIILFTNMGGLNKSNPLLYLIIFGFIYIIMDIFYSFKDIGFWSMIPALTFDSREHEKTATFARIGSTIGGNLVGVVVMPLVLFFSLNSNGGTGDTRGWFWFAVIVATIAWLSAVAVGIGTKKVDSDLRKNKEKTTFKKVIHILTHNDQLMWIALSYGLYTTGVTLVNSLELYYFTFILGNSSAFSIFASLNIVTGLLSVSLFPKLADKLNRRNLFFWCILTMIIALVLFVFAGQSLPMVLIAAVLFAIPQPLVFLVVLMTISDSVEYGQLKLGHRDESLTLSVRPLLDKLAGAISNGVVGLTAVAAGMTTGATAASVSASGQVTFKLIMFGLPIVIILIGTYVFYLKVTLTEKKHAEIVDQLERTWGKQLADDSENPVTTSTKIEAGAHDYNAPIAGELVDLASVNDPIFANGALGQGFAIKPSDGRVYAPFDGTVRIAFSTRHAVGLVSDTGVVTLIHIGIGTVAMQGTGFVTYFERGQHVKRGDLLIEFWDKAIKDAGYDDTVIVTITNSSADDTLTLKKPLGSLVDKDDVILTLENNG

SEQ ID NO: 78 - protein, 644 aa, Weissella paramesenteroides
MKTENSKQSALSRWSYSFGAFGNDVFFATLSTYFIMFVTTHLFSGGNSATNNKMISAITLIIFLLRFVELAIDPFIGNAIDNTRTRWGKFKPWVVIGGTIGSIALIILFTSMGGLNKSNPMAYLILFAIIYITMDIFYSFKDIGFWSMIPALTFDSREREKTATFARIGSTLGANLVGVVVMPLVLFFSVKSNGGTGDTRGWLWFAIIISVVAWISAIAVGVGTKEVDSELRQNKEKTTVKQVIKILVKNDQLMWTAVAYGLYTTGMTLVNSLELYYFTFILGDAKSFSILASLNVVTGLISVSLFPKLADKLNRRKLFFWSVGVMLLGLVVFIFAGKSLPVILVAAELFAIPQPLVFLVVLMTISDSVEYGQLKLGHRDESLTLSIRPLLDKLAGAISNGVVGLTAVVAGMTSGATAASITHANSLTFKAIMFGIPIIIIVAGVFVFFKKVTLTEAKHAEIVDELERTWGKQFNDTNETVTEVLPELSAGESIYYTPVTGTLLPLSRVNDKAFASGDLGKGFAIKPADGRVYAPFDGTIRIAFSTRHAVGIVSDTGIVTLIHIGLDTVKLQGTGFVSYFERGQHVNKGDLLIEFWDKSITDAGLDDTVIVTITNSDDLTTFELLEEPNTLIEQSTPILKLGRY

SEQ ID NO: 79 - protein, 647 aa, Pediococcus pentosaceus
MDAEVKQSKSRKITSRLAYSFGAFGHDAFYATLSTYFIMFVTSHLFDKSSGAQGTKMIAYITMIIAALRFVELAIDPLIGNAIDNTNSRWGHFKPWIVTGGTIGSVVLALLFTSLGGLNTSNPILYLIVFAILYITMDIFYSFKDVGFWSMIPAISFDSAEREKTATYARVGSNIGQNIVGVVVMPIVLMFSTKANSGQGDNRGWMAFGIIIAAVALISALAVAMGTKENDSELRKNTEKTTFKQVFKVLARNDQLMWLSLTYGIYTAGMAITNSLELYYFTYILGDASKFTLLGSLNAIIGVFAVLAFPPLAKKFSRRKVFFLAISVMIIALIMFALAGQSLPMILTSAVLFYIPQPLIFLVVLMVLSDSVEYGQLKFGHRDESLTLSVRPLLDKLGGAISNGVVGLTAVWAGMTAGATAGDVTSHGQAIFKLMMFGVPAAMILIGAFIFFKKVKLDEKMHAEIVDELEKTWSTHLETDETPAEIEKEDGITTLYRNPVSGKLISLDTVADETFASGSMGKGFAIKPTDGQVLAPFDGEVVATFPTRHAIGLRSDTGVLTLIHIGIGTVEMRGTGFVQYVEKGDHVKQGQELIEFWQPAIKKAGLDDTVMVVITNKDMPEFDYLKELGEDVKDSEDVLKLSNTLPN

SEQ ID NO: 80 - protein, 641 aa, Oenococcus kitaharae
MEKTKKTVTSRLSYSFGAFGHDMFYATLSTYFIMFVTSHLFDKESGASGARMIGYITLIIMVLRFIELAIDPFIGNTIDNTTTRWGKFKPWVVVGGTVGSIALTLLFTNLGGLNISNPILYLIIFAVLYITMDVFYSFKDIGFWSMIPALSFDSREREKTATFARVGSTIGQNIVGVIVMPIVLFFSLSSNNGQGDNRGWFAFALIIGLISWISAIAVGLGTKEIDSDLRKNKEKTSLKDVLHVLTRNDQLMWLSLSYAFYATGIQITNALELYYFTYILGNASQFSILATLNTFIGLLAVLLFPPLAQKFNRRNVFFISIAVLVVGIAVFTMAGNSLLLVLIGAELFFIPQPLVFLVVLMTITDSVEYGQLKFGHRDESLTLSVRPLLDKLGGAISNGVVGITAVWAGMTAGASSHTVTGQGSTIFKIMMFGLPLLLVVIATIVFFKKVTLDEKAHAKIVDQLEKSWGKNFSDSKENARIPVAALKEGEFAYYAPISGELVPLKDVSDPTFASGSMGEGFAIKPNDGRVYAPFDGIIRTTFSTRHAVGMVSDDGIASLIHIGVGTVNMRGTGFINYFESGQHVKRGDLLIEFWDPAIQKAGFDDTVIVVITNSNSLSHFELVKSSGQVTKDDLILKLTKK

SEQ ID NO: 81 - protein, 655 aa, Weissella hellenica
MEKVNDLAKQSPMQKAISRISYAFGAFGNDVFYGALSTYFIMFVTTHLFNTGDKAQNDRMIMYITAIITILRVVELIIDPFIGNWIDRTKTRFGQFKPWVVIGGTITSIMLLLLFTDLGGLNQSHPYLYLIVFAILYITMDIFYAFKDVAFWSMIPALSFNSKERERTSSFARIGSTLGGGLVGVVVMPLVLFFSVNQVNGTGDSRGWFAFGLIVALVGIATSWVVGLGTKEVQSDLRKNVKDTVGFKQIFSTLAKNDQLMWIALTYGIYAIGINIENSLVLYYFTFIMGKSTLFSIFQGVNIVISLISVSIFPKLVDRFNRRRVFATCIGIMLAGLLLFSLAGKSFAMVIVAAEMFQVPQAVIFLVVLMIISDSVEYGQLKLGHRDESLTLSIRPLLDKLGGALSNGVVGQVAVIAGMTTGATAASITASGAFKFKFMMFGVPAVLLIIAFIIFWRKSTLTEKRHAEIVDELAKTWGKNIAVEQEETRNVQNIVLTAPVDGQIKPLTSVSDQTFASGQVGRGFAVEPTDGKVYAPFDATIKQVFPTRHAVGLVSEDGVALLIHIGFGTVHMNGTGFVSLVTEGQTVKKGDQLIEFWDPAIQKAGYDDTVTVVVTNWQNFTDFNVVTPVDKQVTAVSEAVFTLKQATNDNKGVSK

SEQ ID NO: 82 - protein, 395 aa, Dickeya chrysanthemi
MTSASPSRSTAWLRVVTLAIAAFIFNTTEFIPVGLLSDIANSFAMKTEDVGLMITIYAWIVAVASLICMLLTSGIERRKLLIGLFSLFILSHLLSAVAWNFTVLVISRAGVALAHSVFWSITASLAIRMAPPGKRAQALGLIATGSSLAMVLGLPLGRVIGQYLGWRVTFLTIAAGATVAMILLARLLPLLPSEHSGSLGSVPKLFRRPALVGIYLLTVVVVTAHFTAYSYIEPFIQTVAGLPENFTTLILLLFGCAGIAGSMLYSRYSDRFPIGFLVTAMLLLLACLTLLMPLSGYPFGLTLLCLVWGLAMMSIGLAMQAKVLSLAPDASDVAMSIFSGLFNLGIGGGALLGSQVSLHLGMDKIGYVGAPLVLVALFATLLSVYRSVRLVHSRV

SEQ ID NO: 83 - protein, 425 aa, Enterobacter cloacae
MNTTTCTHKDNPNFWIFGLFFFLYFFIMATCFPFLPIWLSDIIGLNKTHTGIVFSCISLSAIAFQPVLGVISDKLGLKKHLLWIISVLLFLFAPFFLYVFAPLLKTNIWLGALSGGLYIGFVFSAGSGAIEAYIERVSRNSAFEYGKARMFGCLGWGLCASTGGILFGIDPSYVFWMGSAAALLLMLLLVVAKPKPNQTAQVMNALGANQPQITAKKVFNLFRQRRMWMFILYVIGVACVYDVFDQQFATFFKTFFATPQEGTRAFGFATTAGEICNAIIMFCSPWIINRIGAKNTLLIAGLIMATRIIGSSFATTAVEVIALKMLHALEVPFLLVGAFKYITGVFDTRLSATIYLIGFQFAKQSAAIFLSAFAGNMYDRIGFQETYLMLGCFVLAITVVSAFTLSSRQEIAAAAGAAALTSQSR

SEQ ID NO: 84 - protein, 420 aa, Cronobacter turicensis
MNNTVCTYKNNPNFWILGLFFFFYFFIMATCFPFLPIWLSDVIGLNKTDTGIVFSCMSLFAIAFQPVLGVISDKLGLKKHLLWIITTLLVLFAPFFLWVFGPLLKVNIWLGALTGGLYIGFCFSSGAGAIEAYIERVSRSSAFEYGKARMFGCLGWGLCASTAGMLFNVNPAIVFWMGSCAALVLMGLLLVARPRANQTAQVMNALGANQPQVTAKMALGLFRLPKLWMFILYVVGVACVYDVFDQQFATFFKSFFPTPQAGTQAFGFATTAGELCNAIIMFCSPWIINRIGAKNTLLIAGTIMATRIIGSAFATTVYEVVALKMLHALEVPFLLVGAFKYITGVFDTRLSATIYLIGFQFAKQMAAIFLSAFAGTMYDRIGFQDTYLILGSFVLAITVVSAFTLSSQRQGVALKATVKV

SEQ ID NO: 85 - protein, 420 aa, Cronobacter dublinensis
MTTTACTYKNNANFWIFGLFFFFYFFIMATCFPFLPIWLSDVIGLNKTDTGIVFSCMSLFAIAFQPVLGVISDKLGLKKHLLWIITTLLVLFAPFFLWVFGPLLKVNIWLGALAGGLYIGFCFSSGSGAIEAYIERVSRSSAFEYGKARMFGCLGWGLCASTAGMLFNVNPAMVFWMGSGAALVLMGLLFIARPRVNPTAQVMNALGANQPQVTAKMALGLFRLPKLWMFILYVVGVACVYDVFDQQFATFFKSFFPTPQAGTQAFGFATTAGEMCNAIIMFCSPWIINRIGAKNTLLIAGTIMATRIIGSAFATSVYEIIALKMLHALEVPFLLVGAFKYITGVFDTRLSATIYLIGFQFAKQLAAIFLSAFAGNMYDRIGFQDTYLILGSIVLSITVVSAFTLSSHRPGVALKETVKA

SEQ ID NO: 86 - protein, 420 aa, Cronobacter sakazakii
MKNTVCTPKHNPNFWIFGLFFFFYFFIMATCFPFLPIWLSDVIGLNKTDTGIVFSCMSLFAIAFQPVLGVISDKLGLKKHLLWIITTLLVLFAPFFLWVFGPLLKVNIWLGALMGGLYIGFCFSSGAGAIEAYIERVSRSSGFEYGKARMFGCLGWGLCASTAGMLFNVNPAIVFWMGSSAALVLMGLLLFARPRANQTAQVMNALGANQPQVTAKMALGLFRLPKLWMFILYVVGVACVYDVFDQQFATFFKSFFPTPQAGTQAFGFATTAGELCNAIIMFCSPWIINRIGAKNTLLIAGTIMATRIIGSAFATNVYEIVALKMLHALEVPFLLVGAFKYITGVFDTRLSATIYLIGFQFAKQMAAIFLSAFAGTMYDRIGFQDTYLILGSFVLAITVVSAFTLTNTRQAVVSEETVKA

SEQ ID NO: 87 - protein, 421 aa, Klebsiella pneumoniae
MNPTVCTHKNNPNFWIFGLFFFLYFFIMATCFPFLPIWLSDVIGLNKTETGLVFSSLSLFAICFQPVLGVISDKLGLKKHLMWIVTVLLVLIAPFFLYVFAPLLKTNIWLGALSGGAYIGFVFSAGAGAMEAYIERVSRNSGFEYGKARTFGCLGWALCATTAGMLFSINPEWVFWMGSAAALLLVVLVAIAKPQASQSAQVMDSLGANRPAIDLKTAVRMFRQRKMWMFILYVIGVACVYDVFDQQFATFFKSFFATPEAGTRAFGFATTAGEICNAIIMFSSPWIINRIGAKNTLLIAGMVMAARMIGSSFATTAAEVVALKMLHALEVPFLLVGAFKYITGVFDVRLSATIYLVGFQFAKQVAAIFLSAFAGNMYDRIGFQETYMILGGIALTVTLISAFTLAGKAKTEPLRDNAMTV

SEQ ID NO: 88 - protein, 392 aa, Escherichia coli
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALAREYADNSAREVVMFSSVMRAQLSLAWVIGPPLAFMLALNYGFTVMFSIAAGIFTLSLVLIAFMLPSVARVELPSENALSMQGGWQDSNVRMLFVASTLMWTCNTMYIIDMPLWISSELGLPDKLAGFLMGTAAGLEIPAMILAGYYVKRYGKRRMMVIAVAAGVLFYTGLIFFNSRMALMTLQLFNAVFIGIVAGIGMLWFQDLMPGRAGAATTLFTNSISTGVILAGVIQGAIAQSWGHFAVYWVIAVISVVALFLTAKVKDV

SEQ ID NO: 89 - protein, 1035 aa, Acinetobacter baumanii
MSQFFIRRPVFAWVIAIFIIIFGLLSIPKLPIARFPSVAPPQVNISATYPGATAKTINDSVVTLIERELSGVKNLLYYSATTDTSGTAEITATFKPGTDVEMAQVDVQNKIKAVEARLPQVVRQQGLQVEASSSGFLMLVGINSPNNQYSEVDLSDYLVRNVVEELKRVEGVGKVQSFGAEKAMRIWVDPNKLVSYGLSISDVNNAIRENNVEIAPGRLGDLPAEKGQLITIPLSAQGQLSSLEQFKNISLKSKTNGSVIKLSDVANVEIGSQAYNFAILENGKPATAAAIQLSPGANAVKTAEVVRAKIEELKLNLPEGMEFSIPYDTAPFVKISIEKVIHTLLEAMVLVFIVMYLFLHNVRYTLIPAIVAPIALLGTFTVMLLAGFSINVLTMFGMVLAIGIIVDDAIVVVENVERIMATEGLSPKDATSKAMKEITSPIIGITLVLAAVFLPMAFASGSVGVIYKQFTLTMSVSILFSALLALILTPALCATILKPIDGHHQKKGFFAWFDRSFDKVTKKYELMLLKIIKHTVPMMVIFLVITGITFTGMKYWPTAFMPEEDQGWFMTSFQLPSDATAERTRNVVNQFENNLKDNPDVKSNTTILGWGFSGAGQNVAVAFTTLKDFKERTSSASKMTSDVNSSMANSTEGETMAVLPPAIDELGTFSGFSLRLQDRANLGMPALLAAQDELMAMAAKNKKFYMVWNEGLPQGDNISLKIDREKLSAFGVKFSDVSDIISTSMGSMYINDFPNQGRMQQVIVQVEAKSRMQLKDILNLKVMGSSGQLVSLSEVVTPQWNKAPQQYNRYNGRPSLSIAGIPNFDTSSGEAMREMEQLIAKLPKGIGYEWTGISLQEKQSESQMAFLLGLSMLVVFLVLAALYESWAIPLSVMLVVPLGIFGAIIAIMSRGLMNDVFFKIGLITIIGLSAKNAILIVEFAKMLKEEGMSLIEATVAAAKLRLRPILMTSLAFTCGVIPLVIASGASSETQHALGTGVFGGMISATILAIFFVPVFFIFILGAVEKLFSSKKKISS

SEQ ID NO: 90 - protein, 1037 aa, Escherichia coli
MANFFIDRPIFAWVLAILLCLTGTLAIFSLPVEQYPDLAPPNVRVTANYPGASAQTLENTVTQVIEQNMTGLDNLMYMSSQSSGTGQASVTLSFKAGTDPDEAVQQVQNQLQSAMRKLPQAVQNQGVTVRKTGDTNILTIAFVSTDGSMDKQDIADYVASNIQDPLSRVNGVGDIDAYGSQYSMRIWLDPAKLNSFQMTAKDVTDAIESQNAQIAVGQLGGTPSVDKQALNATINAQSLLQTPEQFRDITLRVNQDGSEVRLGDVATVEMGAEKYDYLSRFNGKPASGLGVKLASGANEMATAELVLNRLDELAQYFPHGLEYKVAYETTSFVKASIEDVVKTLLEAIALVFLVMYLFLQNFRATLIPTIAVPVVLMGTFSVLYAFGYSVNTLTMFAMVLAIGLLVDDAIVVVENVERIMSEEGLTPREATRKSMGQIQGALVGIAMVLSAVFVPMAFFGGTTGAIYRQFSITIVAAMVLSVLVAMILTPALCATLLKPLKKGEHHGQKGFFAWFNQMFNRNAERYEKGVAKILHRSLRWIVIYVLLLGGMVFLFLRLPTSFLPLEDRGMFTTSVQLPSGSTQQQTLKVVEQIEKYYFTHEKDNIMSVFATVGSGPGGNGQNVARMFIRLKDWSERDSKTGTSFAIIERATKAFNQIKEARVIASSPPAISGLGSSAGFDMELQDHAGAGHDALMAARNQLLALAAENPELTRVRHNGLDDSPQLQIDIDQRKAQALGVAIDDINDTLQTAWGSSYVNDFMDRGRVKKVYVQAAAPYRMLPDDINLWYVRNKDGGMVPFSAFATSRWETGSPRLERYNGYSAVEIVGEAAPGVSTGTAMDIMESLVKQLPNGFGLEWTAMSYQERLSGAQAPALYAISLLVVFLCLAALYESWSVPFSVMLVVPLGVIGALLATWMRGLENDVYFQVGLLTVIGLSAKNAILIVEFANEMNQKGHDLFEATLHACRQRLRPILMTSLAFIFGVLPMATSTGAGSGGQHAVGTGVMGGMISATILAIYFVPLFFVLVRRRFPLKPRPE

SEQ ID NO: 91 - protein, 417 aa, Escherichia coli [sequence omitted]

SEQ ID NO: 92 - protein, 438 aa, Escherichia coli
MGNTSIQTQSYRAVDKDAGQSRSYIIPFALLCSLFFLWAVANNLNDILLPQFQQAFTLTNFQAGLIQSAFYFGYFIIPIPAGILMKKLSYKAGIITGLFLYALGAALFWPAAEIMNYTLFLVGLFIIAAGLGCLETAANPFVTVLGPESSGHFRLNLAQTFNSFGAIIAVVFGQSLILSNVPHQSQDVLDKMSPEQLSAYKHSLVLSVQTPYMIIVAIVLLVALLIMLTKFPALQSDNHSDAKQGSFSASLSRLARIRHWRWAVLAQFCYVGAQTACWSYLIRYAVEEIPGMTAGFAANYLTGTMVCFFIGRFTGTWLISRFAPHKVLAAYALIAMALCLISAFAGGHVGLIALTLCSAFMSIQYPTIFSLGIKNLGQDTKYGSSFIVMTIIGGGIVTPVMGFVSDAAGNIPTAELIPALCFAVIFIFARFRSQTATN

SEQ ID NO: 93 - protein, 247 aa, Arabidopsis thaliana
MNIAHTIFGVFGNATALFLFLAPSITFKRIIKNKSTEQFSGIPYPMTLLNCLLSAWYGLPFVSKDNTLVSTINGTGAVIETVYVLIFLFYAPKKEKIKIFGIFSCVLAVFATVALVSLFALQGNGRKLFCGLAATVFSIIMYASPLSIMRLVVKTKSVEFMPFFLSLFVFLCGTSWFVYGLIGRDPFVAIPNGFGCALGTLQLILYFIYCGNKGEKSADAQKDEKSVEMKDDEKKQNVVNGKQDLQV

SEQ ID NO: 94 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 95 - protein, 289 aa, Arabidopsis thaliana
MAISQAVLATVFGILGNIISFFVCLAPIPTFVRIYKRKSSEGYQSIPYVISLFSAMLWMYYAMIKKDAMMLITINSFAFVVQIVYISLFFFYAPKKEKTLTVKFVLFVDVLGFGAIFVLTYFIIHANKRVQVLGYICMVFALSVFVAPLGIIRKVIKTKSAEFMPFGLSFFLTLSAVMWFFYGLLLKDMNIALPNVLGFIFGVLQMILFLIYKKPGTKVLEPPGIKLQDISEHVVDVVRLSTMVCNSQMRTLVPQDSADMEATIDIDEKIKGDIEKNKDEKEVFLISKN

SEQ ID NO: 96 - protein, 289 aa, Arabidopsis thaliana
MSLFNTENTWAFVFGLLGNLISFAVFLSPVPTFYRIWKKKTTEGFQSIPYVVALFSATLWLYYATQKKDVFLLVTINAFGCFIETIYISMFLAYAPKPARMLTVKMLLLMNFGGFCAILLLCQFLVKGATRAKIIGGICVGFSVCVFAAPLSIIRTVIKTRSVEYMPFSLSLTLTISAVIWLLYGLALKDIYVAFPNVLGFALGALQMILYVVYKYCKTSPHLGEKEVEAAKLPEVSLDMLKLGTVSSPEPISVVRQANKCTCGNDRRAEIEDGQTPKHGKQSSSAAAT

SEQ ID NO: 97 - protein, 224 aa, Batrachochytrium dendrobatidis
NFMTLLEWCAILLTVGMFLTNFNTLRLYMRTGTTGHATTIPFVCTLLNCSLWFRYGLLVQLTSLVIVNAVGILVSIVSLYVFCKYTDRQSDAQIPIITALGFLYLVFVYVHLVSGSAMLKQYGFLTATFSIFMYGAPLLSLANVIQLKSATGLISLPMTCISLIVCCLWTAFGYQIQDNFVLIPNTIGGILCLFQLIVLRIYPDEKNGYTIHQPSLPMSDRRSY

SEQ ID NO: 98 - protein, 233 aa, Batrachochytrium dendrobatidis
MSTIECSTPNCQLVLHHIIPIIGVFTALWIFIAPFKSVKRLGNSDNLENVNPLPFPMIVANCLGWLVYGLLIQDIYVIIPNIIGYQFGIYYTLMAYRIAAPEFQSRALQILIGSSLLVFIGGVLGFIVLQGNEAGRIVMGLVCVVILAVFYCSPLSDFYNVIKKKDASSIDVYLAAASLVNGSLWTVYGFAIGDTFIWSPNLLGVVLSLVQFVLLAIFARPKSHEFQVLRNAT

SEQ ID NO: 99 - protein, 236 aa, Batrachochytrium dendrobatidis
MSAIVMNHVLPALGVAFAISIYLSPFTHVWKSLKNKEASLVNTMPYPWIIANCLGWIVYGCHTGDYYVFVANIVGYHLGLFYTLSSLHYGSDKFRTTAAVIVLGSSFLVLTSAFVVFAILRQAQPSKTVLGSVCVFILVIFYASPLSDLASVIRSRDASSINPILGFCSLLNGALWTGYGFAISDPFIWAPNVVGVVLSIVQLFLCFLFRGNKSTVNSQGTLPTSKALEAEYHHST

SEQ ID NO: 100 - protein, 233 aa, Rozella allomycis
MADFLLGQIVPALGACISIFLFLSPMKAFMVHSTKYDFNPLAAITMILNCLSWIFYGIFVKDIYIITPNVPGLTLSVWYTVNVYHHGVANNPQRKYYDAILVLGIFLILLVDSAIAPQLLDVAAAQTMAGYMCIIMLLFFYISPLSTLANCVKEKSAVSIHFGLSVASLVNGLLWTVYGIAIQDAFVYGPNFVGCLSASVQLLLKFIYRKSDKALLPLRNIEKDSLDSAEIAS

SEQ ID NO: 101 - protein, 231 aa, Albugo Candida
MENVFLVSTLLMTKSIPVIAAGSSLIFAISPMTTTRSIQRAKSTLQYPFAPFFFFFIQNVITLLYAYATWNHIIALTAALSSSLGAYYVYIYYKHSKQKTHPRRMLGIACFGILLLAVNALPREPEDAQWIIGVPSLILSILTSSSPLMQIRDILKRKDASCLPFGMSVMNLISGSVWTLYGSILKDPLIIVPNIIALSMGIVQVSLIFLYPSKSTRKANWESDGGIERAD

SEQ ID NO: 102 - protein, 237 aa, Albugo Candida
MSTWQSMENVFLVSTLLMTKSIPVIAAGSSLIFAISPMTTTRSIQRAKSTLQYPFAPFFFFFIQNVITLLYAYATWNHIIALTAALSSSLGAYYVYIYYKHSKQKTHPRRMLGIACFGILLLAVNALPREPEDAQWIIGVPSLILSILTSSSPLMQIRDILKRKDASCLPFGMSVMNLISGSVWTLYGSILKDPLIIVPNIIALSMGIVQVSLIFLYPSKSTRKANWESDGGIERAD

SEQ ID NO: 103 - protein, 224 aa, Albugo Candida
MSSLYLFASPFADIRAIQAAKIKHSRRILPLTSMFCNAICWCLYGILAHNIFPLLLTNAVGIIIVTYYLYIFSKYASDSVHVRKCLIGMAVTLSIFFSFCLFAPVSHATVQSVVGYTGISVCTVMFASPLAVVKKVIAEKSSDMLPFPMIVAAFMNSILWLVYGLMIHDIIVFLPNLINFFLAGMQLSLFVIYPRTKGYVSMHSSVAIMDAKIFVPVSSDLEKA

SEQ ID NO: 104 - protein, 180 aa, Albugo Candida
MASVLAFCMCLSPIPDMIHIQKERSTDSLPLLSLVALWINCHVCAMSIVYLVIYQKYAYCHTRVLLSNLCAFILNICLTIFACTGSSIVSQETLVKCFGYIANVSGLLLYGSPLINVVEAVQAKNATSIPIAMTVVGLANNATWILYGFLIDDIYLIAPCVINTMVCLIQLFVCAVLQLT

SEQ ID NO: 105 - protein, 399 aa, Bacillus subtilis
MHNLQVRRHYAALKGFYLFAFLGTGSIIPLLSMYLTKEQHLSGSQVGLIMSLGPIVMIFFQPFWGMLSDYTQKTKGLLAVCTSITGIIGLAYIAFDSFPLFILIAACFAAFQSTIIPLSDSISLRYTQETNGNYGGIRLFGSLGFGVAVFAMGQVTNQLYPIHVIFIFGCAFLCIAAILASQVPGQQKTTKVNIRKGFRELISNKTFLIFMIITFTTFAPNLANNTYFSLFLDKSGASLSAIGILFFIGVISEIPFMRFAQTFIDKMGLLNVIMLSGGVSLFRWALYFTAPSLWIIYATVFLQGVAIGLFIPAALQYVKKITPRHVEATALTMYAAIGNGFGNWFCTFAGGYIFDYVSIFAVYLLFGILSIAGFGLTLYLMKAEKNKHTLHQPAVTFKP

SEQ ID NO: 106 - protein, 392 aa, Bacillus subtilis
MWLANFFVSASTTMIVPFLSLYIETLSSFSNGFVQRWSGYVFGITFLMAFLVSPFWGRFGDKRGYKKILMATGTGIALSIFFMGFVTSVYQLFFLRMAMGLVTGFIPTSLAMISAQTPKSSAGKTLGTLQMGQVSGSLFGPLLGGMLADRFGFTYTFFITSFVIFSSVLLVLFGVKEKHLAEKTAKRTSYSRKEVLSYIFHHPALWVMMLLTMLIQTGNFSIQPLLALYVNELHGPVNLAFFSGMAFSATGLGSLLLARKWGDLGDRYGHRRILIGLLLAASFFFIPQALASSLSVLLVFRFLFGMAMGGLLPCITAAIRVQAPGSIQGEVLGYNVSFRFLGNVLGPLLGGIISSHFTISATFYVTAFLFFAGACMLWIMQKLRKDSYAKAS

SEQ ID NO: 107 - protein, 561 aa, Mucor circinelloides
MPYLAPKLLYTFLFACQGSAPVYLALFYSSQLGLKGDQIGLLVAIAPFISAIACPLWAAIADKTKTHSYIMCIVHTLATIAIVSVMGISVVVQPIVDEVDRNKLTIALVTVTSVCFAFFGVPVLPLVDGGVLKILGRNKDQYGRQRMFGSISFGVASSLVGFITDWTDDMNAIFYIYSFSAICFILVCGNTQFKSERIDDGHHRPYLIRTRSSSTMTSTLNTTNTPNNHKKSLPSTSTTTLNNTTSISTSSSMNNNNRRKMKQFQVDPYDEVGIDLDSSQIRQNEIQRLIQFATESSIIEAVNLSNPPSHRRNARPPRVDEPATLMQLLKKPDVSLFFLTMMLMGAALNMVVSFLFIYLKQDLGASSSQVGLTGLIGSSTELVFFFYSKDLIRLFGIKSLIILGHILTIIRVFAYTIIPKGPTGANIALGLHLLNGVAFSALWGAGVVQADELAPPSLQATSQGVLAAMYTGIGAGLGSLVGGVIYEQYGCNAMFYTVIALTLTSLEIYLETNTRCGVSDMMRWLYRTAIHVYQWIQHARGIGQAVPRWSGGGRIRLEDDA

SEQ ID NO: 108 - protein, 394 aa, Geobacillus stearothermophilus
MGAAFKWGAAARKTVFPLFYFLIFFAFGALFPLLSVYLQEEARLSGAAIGWIMSLPPIVTMAAQPLWGTAADYTRKPVGLLLAALVLAALFGVMYALAGSYRLFVVLTVLLSAMQSAIVPLSDSLALRHVHEQGGNYGAIRLWGSLGFAMAVLAVGWLSDHIAFAVIFYAFSLALLTAAALATRLPRYPMGAPGALTRQDVRGLLASRPFRLLLVATFLLFGPILANNSYFGLLIHELGGTLTGIGLAFLFAAGSEAPFMKAADRLIGRFGMVRLLLLAALISAARWLAYAADPPLWFVYMTTVVQGCSVGLAIPTALQYARRLAPERVQSTAVALYSAVGNGLGAWFCTLVGGYLLERWQIGAVYLFFSICTIVGVLVLLLLAKRERTAGEEK

SEQ ID NO: 109 - protein, 272 aa, Bifidobacterium longus infantum
MRFLGKGLVYVFVIVMAALTLFPFLYMLSSSLMTYQEVTSIPPTIVPHVPQWHNFVEAMRQAPFPRYFLNTVLVSGLSTLGTIITTVLAAFALVRLRFRFKKALMMGMMALLMVPYEVVVFTNYRTINQLGLLDTYWALILPSLASVFYIFYLQQYLSSIPAAYYNAAKVDGCGDLEFIWKVMIPMSRPALFTMALLLFIGGWNSFLWPILVTNSTDMRLISNGLSAFATETGTAVQLQMAASTATIVPILVLYFIFHKQIIEGVSSNGIKG

SEQ ID NO: 110 - protein, 315 aa, Bifidobacterium longus infantum
MEERREKSIAVTALNEGGGGKSHRSGRYSAERQPHAWLLLFPALALITVFNLLPLVRIFIMSLQGGTLTRQRFVGMRNFVFVFADPEFRKAIANTALFAFVVVSVGLVLSMAVAVAINGKLRGGRVFEILFFIPYLTSVIAIGMVFRYLFNGDYGLVNYVLGLCGLGPYDFLNDPKFNMPTLIIFGIWSSLAFNIIILLSGLRGIDKEYYKVADMFGATAWEKFRRITLPQMVPILTFLSIVDFINSFKVYTEVYALFNGKAGIGDSATTAVFYVFNKFYVDNKYGQGMAAAVVLFLVILAFTIIQGIVLRRLAK

SEQ ID NO: 111 - protein, 405 aa, Bifidobacterium longus infantum
MALDVGKALKSKTLVVGVLSMSLLMSASNAVSGTIPAMKEAFSDYSAANVELLTTVPTIGSMVGTALTGLFANAIGRKKIAMAGFLISAVTGVIPAFFPYYWPILISRMFFGFGSALFVTLSVSYITDLYDGDMQRKLLGWRQAVGNLGDVVLLFVASLLITINWQSTYLIFFLLFVPMVLVGMFIPKEFDNFSIRSALVDDEGHVVDKSASQKQTTNWQVLWLAFIFLVVSMLYNVMSIKLASYVVDEGIGSASLATLIFSFLVVATILSGVLFDKVAKVTKRLTVTISEVVIGICFIATALTKNVPLMFALVLIAGFAWGIINPALTARFVDYSPAHSMNLTTSIVIIGINIGCLISPYFFALTASIFGNSSAGFAIIVGGALYLVMVVIELITLKVDKKLTV

SEQ ID NO: 112 - protein, 320 aa, Bifidobacterium longus infantum
MTSTSINPAPVRGAGSDDIPFNPKLRQRRSVSDWVVDIVIWLLIALVVVAIVYPIWFIVIASVSDQTMVSQGKVFLLPAKMNFGGYAKVFTDSRIWVGYRNTIFYSVAGTALNMLVTIPAAFALSRREFKPRRVILFLMTFTMFFSGGMIPSFLLYKQLGLLNSVWVFILPGAVSVWNLIVARSFFESSIPESLHDAAQIDGLGYFGYFLRIVLPLSSAILAVMTLYYFVGHWNDFFTGLVYIRDADKLPLQNVLRSILLSNQTNITGQSSGGMDVVQQRDFANQIKYGVIIVSTLPLLVLYPFLQKYFNKGVMIGAVKG

SEQ ID NO: 113 - protein, 317 aa, Bifidobacterium longus infantum
MSVVKQGEVVDNALAARSAPLPVRLGRHFRRYGALWLMTLPALVFVGLFAYVPMYGLRLAFYDFDPVEGLMGGRFAGLRYFEQFFRSGMFVNIMVNTLRISLWTLVMGFIAPIVLALLINQISSSKIKGFVQTVTYMPHFISTVVIVSMINIFLSPSTGMIGRLFPGTDLLGEPGLFTPIYWISEVWQHMGWNCIIYLAALSSVDLSLYEAAKIDGAGRLQLIRYVDIPAIMPTVGIMLIMNMGSVLNVGFEKVLLMQNPMNLSVSEVIATYTYRMGILGNQFSYTTAIGLFNTVVNFFFLVLANFISKRASDTSIF

SEQ ID NO: 114 - protein, 320 aa, Bifidobacterium longus infantum; identical to SEQ ID NO: 112

SEQ ID NO: 115 - protein, 317 aa, Bifidobacterium longus infantum; identical to SEQ ID NO: 113

SEQ ID NO: 116 - DNA, 1764 bp, Kluyveromyces lactis
atggccgaccactcaagttccagctcttctttgcaaaagaaaccaatcaacaccatcgaacacaaggatactttgggaaacgacagagatcacaaggaagccttgaactccgacaacgacaatacttctggcttgaagattaacggtgttccaatcgaggatgccagagaagaagtcttgttacctggttacctatccaagcaatactacaaattgtacggtttatgtttcatcacttacttgtgtgctaccatgcaaggatacgatggtgctttgatgggctctatctacaccgaagacgcttacttaaagtactaccacttggatatcaactccagttctggtaccggcttggttttctccattttcaacgttggtcaaatctgtggagctttctttgtcccattgatggactggaagggcagaaaaccagctatcctaattggttgtttgggcgttgtcattggtgctatcatcagttctttgactacaaccaagtctgctttgatcggtggcagatggtttgttgctttcttcgccactattgccaacgctgccgctccaacttactgtgccgaagttgctccagctcacttgcgtggcaaggttgctggtttgtacaacaccttatggtccgtcggttctattgttgctgccttctctacttacggtaccaacaagaatttcccaaactcttccaaggctttcaaaatccctttgtacttacaaatgatgttcccaggtttggtttgcattttcggttggttgatcccagaatctcccagatggttggtcggtgttggaagggaggaagaagccagagagttcatcattaagtaccacttgaacggcgacagaacccacccattgctggacatggagatggccgaaatcattgagtctttccacggtaccgacttgtccaacccactggaaatgttggacgttcgttctctattcagaaccaggtccgaccgttacagagctatgttggtcatcttaatggcctggtttggtcaattctctggaaacaatgtttgttcttactacttaccaactatgttgagaaacgttggtatgaagtccgtctctctaaacgtattgatgaatggtgtctactctatcgttacctggatatcttccatttgtggtgctttctttatcgacaagattggcaggagagaaggtttcttgggctccatctctggtgctgccttggctttaactggtctatctatctgtactgccagatacgaaaagaccaagaaaaagtctgcctccaacggtgctttggttttcatctacctatttggtggaatcttctcttttgctttcactccaatgcaatctatgtactccaccgaagtctctacaaacttgaccagatcaaaggctcaattgttaaacttcgttgtctctggtgtggctcaattcgtcaaccaatttgccactccaaaggctatgaaaaacatcaagtactggttttacgttttctacgtcttctttgacatcttcgagttcattgtcatctactttttcttcgtcgaaaccaagggcagatccctggaagaattggaggttgtcttcgaagctccaaacccgagaaaggcttctgtcgatcaagccttcttggctcaagtcagagccactttggttcaaagaaacgacgtccgtgttgccaatgctcaaaacttgaaggagcaagaaccattgaagtccgacgccgatcatgtcgaaaagttgtccgaggccgaatctgtttag

SEQ ID NO: 117 - DNA, 30 bp, artificial sequence
  primer
ctaaacagattcggcctcggacaacttttc

SEQ ID NO: 118 - DNA, 60 bp, artificial sequence
  Primer
agaaagatttaattatcaaacaatatcaatatggccgaccactcaagttccagctcttct

SEQ ID NO: 119 - DNA, 470 bp, Saccharomyces cerevisiae
tttttacctctgtggaaattgttactctcacactctttagttcgtttgtttgttttgtttattccaattatgaccggtgacgaaacgtggtcgatggtgggtaccgcttatgctcccctccattagtttcgattatataaaaaggccaaatattgtattattttcaaatgtcctatcattatcgtctaacatctaatttctcttaaattttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaat

SEQ ID NO: 120 - DNA, 42 bp, artificial sequence
  primer
gcaaaggatcctttttacctctgtggaaattgttactctcac

SEQ ID NO: 121 - DNA, 30 bp, artificial sequence
  primer
attgatattgtttgataattaaatctttct

SEQ ID NO: 122 - DNA, 250 bp, Saccharomyces cerevisiae
tgaacccgatgcaaatgagacgatcgtctattcctggtccggttttctctgccctctcttctattcactttttttatactttatataaaattatataaatgacataactgaaacgccacacgtcctctcctattcgttaacgcctgtctgtagcgctgttactgaagctgcgcaagtagttttttcaccgtataggccctctttttctctctctttctttctctcccgcgctgatctcttcttcgaaaca

SEQ ID NO: 123 - DNA, 60 bp, artificial sequence
  primer
gaaaagttgtccgaggccgaatctgtttagtgaacccgatgcaaatgagacgatcgtcta

SEQ ID NO: 124 - DNA, 44 bp, artificial sequence
  primer
tccattgtttaaactgtttcgaagaagagatcagcgcgggagag

SEQ ID NO: 125 - DNA, 4827 bp, artificial sequence
  pUC19-URA3-YPRC?15 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtaccccaaaaggaatattgggtcagatgaatggacgcgaatgcaagacagaagtccaaatcacgtcaagacaaagaaagaaagaaagaaaaactaacacattaatgtagttttaaaatttcaaatccgaacaacagagcatagggtttcgcaaaggatccggcgcgccgtttaaacaatggaaggtcgggatgagcatatacaagcactaagaagaacaatacagaactctacacggtattattgtgctacaagctcgagtaaaaccgagtgttttgacgatactaacgttgttaagaaagtaacttgttatcaaactcattaccaacttgtgattaattggtgaataatatgataattgtcgaaattccattgttggtaaagcctataatattatgtatacagattatactagaaattctctcgagaatataagaatccccaaaattgaatcggtatttctacatactaatattaccattacttctcctttcgttttatatgtttcattcctattacattatcgatctttgcatttcagcttccattatatttgatgtctgttttatgtccccacgttacaccgcatgtgacagtatactagtaacatgagtgctaccgaatagatgacattttagactttcattccaacaacttggttgacagaatgttacgtaggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttcatatatgacgtaataaaatgaaatgtagattcattttgtagattcctatatcctcagagagaatttttggtatatcctatatgcataatattatagtctttgccaacaatcgaaaccaaacatatatcttaaaatacaccactttctcaaataaattcgttaaataacggtgtgttgaaatgtttaccgtaacttgtaacagctctaacaactcatacctgctatgtactgattccaagaaaaaaaattaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 126 - DNA, 20 bp, artificial sequence
  primer
tcttaaaatgctcttcttat

SEQ ID NO: 127 - DNA, 20 bp, artificial sequence
  primer
cgaaactaatggaggggagc

SEQ ID NO: 128 - DNA, 20 bp, artificial sequence
  primer
acaatggaatttcgacaatt

SEQ ID NO: 129 - DNA, 22 bp, artificial sequence
  primer
gagaagatgcggccagcaaaac

SEQ ID NO: 130 - DNA, 20 bp, artificial sequence
  primer
taacgcctgtctgtagcgct

SEQ ID NO: 131 - DNA, 1700 bp, artificial sequence
  5' fragment of beta-galactosidase from Kluyveromyces lactis
atgtcttgtttgatcccagaaaacctaagaaatccaaagaaagttcacgaaaacagattgccaaccagggcttactactacgaccaagatatcttcgaatccttaaacggtccttgggcttttgccttattcgacgctcccttggatgctccagacgccaagaacttggattgggaaactgccaagaaatggtctactatttccgttccatctcactgggaactacaagaggactggaaatacggcaagccaatctacaccaacgtccaatacccaatacctatcgacattccaaaccctccgaccgtcaatccaactggtgtttacgctcgtactttcgaattggactccaagtctatcgaaagtttcgagcacagattgcgtttcgaaggtgtcgataactgttacgaattgtacgtcaacggtcaatacgttggcttcaacaagggttccagaaatggagccgaattcgatatacaaaagtacgtttccgagggcgaaaacttggttgttgtcaaagtgttcaagtggtccgactctacttacatcgaagaccaagatcaatggtggttatctggtatctacagagacgtctctttgttaaagctaccaaagaaagctcacatcgaagacgtcagagttacaaccactttcgtcgattctcaataccaagacgccgaattgtctgttaaggtggatgtccaaggcagttcttacgatcacatcaacttcaccttgtacgagccagaagacggttccaaagtttacgacgcttcttccttgctaaacgaagagaatggcaacaccactttttctacaaaggaattcatttccttttctaccaagaaaaacgaagagactgctttcaagatcaacgtcaaagctccagaacactggactgccgagaacccaaccttgtacaagtaccaactggatttgattggctccgacggttcagttattcaatctatcaagcaccatgtcggtttcagacaagtggaattgaaggatggcaatatcaccgtcaacggcaaggacatcttgttccgtggtgtcaacagacacgaccaccatccacgtttcggcagagctgtcccattggatttcgttgtcagagacttaatcttgatgaagaaattcaacatcaatgctgtcagaaactctcattacccaaatcaccccaaggtttacgatttgttcgacaagctgggtttttgggttatcgacgaagccgatttggagacccacggtgttcaagaaccattcaacagacacaccaatttggaagccgagtacccagacaccaagaacaaattgtacgacgtcaacgctcactacttgtccgacaacccagaatacgaggttgcttacttggacagagcctctcaattggttttacgtgacgtcaaccacccatccatcatcatttggtctttgggcaacgaagcctgttacggcagaaaccacaaggctatgtacaaactaatcaagcaactggacccaaccagattggttcactacgaaggcgacttaaacgctttgtctgccgacatcttctcctttatgtacccaaccttcgaaatcatggagcgttggagaaagaatcacaccgacgaaaacggcaagttcgagaaaccattgattctatgcgaatacggtcacgctatgggcaacggaccaggttctttgaaagagtacca

SEQ ID NO: 132 - DNA, 1438 bp, artificial sequence
  3' fragment of beta-galactosidase from Kluyveromyces lactis
gattctatgcgaatacggtcacgctatgggcaacggaccaggttctttgaaagagtaccaagaattgttttacaaagagaagttctaccaaggtggctttatctgggaatgggccaaccacggtatcgaattcgaggacgtttctactgccgatggcaagttgcacaaagcctacgcttacggtggcgatttcaaggaagaggtccacgacggtgttttcattatggacggtttgtgcaacagcgaacacaatccaactcctggtttggtcgaatacaagaaagttatcgaaccagtccacatcaagattgctcatggttctgttactatcaccaacaagcacgatttcattactacagaccacttgttattcatcgacaaagatactggcaagaccatcgacgttccgtctttgaagccagaagagtctgttaccattccatccgatactacatacgttgtcgctgtgttgaaggacgatgccggtgttttgaaggctggccacgaaattgcttggggtcaagccgaactacctttgaaggtcccagacttcgttaccgaaactgccgagaaagccgctaagatcaacgatggaaaaagatacgtttccgtcgaatcttcaggtttacacttcatcctggacaagttattgggcaaaatcgaatctttgaaggtcaagggaaaagaaatctcttccaagttcgaaggttcttcaattactttctggagaccacctaccaacaacgacgaaccaagagatttcaagaactggaagaaatacaatatcgacttgatgaagcaaaacattcacggagtttctgtcgaaaagggttccaacggctctttggctgtggttactgtcaacagcagaatttctccagttgtcttttactacggtttcgaaactgtccaaaagtacaccattttcgccaacaagatcaatttgaacacctctatgaagttaactggcgaataccaacctcccgacttcccaagagttggttacgaattctggttgggcgactcttacgaatccttcgagtggttgggcagaggtcctggagaatcttacccagacaaaaaggaatctcaaagattcggtttgtacgattccaaggacgtcgaggaattcgtttacgattacccacaagaaaacggaaatcacaccgatactcatttcttgaacatcaagtttgaaggtgctggcaagttatctatcttccaaaaggaaaaaccattcaacttcaagatttccgacgagtacggtgtcgatgaagccgctcacgcttgcgacgtcaagagatacggtcgtcactacctaagattggaccatgctattcacggtgttggctccgaagcctgtggtccagctgttttggaccaatacagactaaaggctcaagacttcaacttcgaatttgacttggctttcgaatag

SEQ ID NO: 133 - DNA, 60 bp, artificial sequence
  primer
ttaccctaccagcaatataagtaaaaaactatgtcttgtttgatcccagaaaacctaaga

SEQ ID NO: 134 - DNA, 17 bp, artificial sequence
  primer
gtaaaacgacggccagt

SEQ ID NO: 135 - DNA, 22 bp, artificial sequence
  primer
cacacaggaaacagctatgacc

SEQ ID NO: 136 - DNA, 60 bp, artificial sequence
  primer
agtttccagcacttgatattattttcctctctattcgaaagccaagtcaaattcgaagtt

SEQ ID NO: 137 - DNA, 9585 bp, artificial sequence
  plasmid pHR81-ILV5p-R8B2y2
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcgaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatgaaggttttctacgacaaggattgtgacttgtctatcattcaaggtaaaaaggtcgccatcatcggttttggttcccaaggtcacgctcaagccttgaacttaaaggactctggtgtcgatgttaccgtcggtctaccaaagggtttcgctgacgttgccaaggccgaagctcacggtttcaaggttactgacgtcgccgctgccgttgctggtgctgatttggtcatgatcctaattccagacgaattccaatcccaattgtacaaaaacgaaatcgaaccaaacatcaaaaagggtgccactttggctttctcccacggtttcgctatccactacaaccaagttgttccaagagctgacttggacgttatcatgattgctcctaaggctccaggtcataccgttagatctgaattcgtcaagggtggtggtatcccagacttgattgctgtttaccaagacgtttctggtaatgccaaaaacgtcgctttgtcctacgctgccggtgttggtggtggtcgtactggtatcatcgaaactaccttcaaggacgaaaccgaaaccgacttattcggtgaacaagctgttttgtgtggtggtaccgtcgaattggtcaaggctggttttgaaactttggtcgaagctggttacgctccagaaatggcttacttcgaatgtttacacgaattgaagttgattgttgatttgatgtacgaaggtggtattgctaacatgaactactctatctctaacaacgctgaatacggtgaatacgttactggtccagaagtcattaacgccgaatctagacaagctatgagaaatgctttgaagagaattcaagatggtgaattcgctaagatgttcatctctgaaggtgctaccggttacccttctatgactgctaagcgtagaaacaacgctgctcacggtatcgaaatcatcggtgaacaactaagagctatgatgccatggattggtgctaacaagatcgtcgataagagaaaaaactgaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagacaacatcatccacggttctatactgttgacccaatgcatctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 138 - DNA, 1089 bp, Saccharomyces cerevisiae
tttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcgaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaact

SEQ ID NO: 139 - DNA, 627 bp, Saccharomyces cerevisiae
agaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatgtgtgcgtgtatgtgtacacctgtatttaatttccttactcgcgggtttttcttttttctcaattcttggcttcctcttt

SEQ ID NO: 140 - DNA, 1122 bp, Escherichia coli
atgtctaaggttgctttgatcactggtgttacaggtcaagacggttcttacttggctgagttcttgttagaaaagggttacgaagtacacggcatcaagagacgtgcttctagcttcaacaccgaaagagttgaccatatctaccaagacccacacacttgtaacccaaagttccacttgcattacggtgatttgtccgatacttccaacttgaccagaatcttgagagaagtccaaccagatgaagtctacaacttgggtgctatgtctcacgtcgctgtttccttcgaatctcctgaatacaccgctgacgttgacgctatgggtaccttaagattgctagaagctatcagattcctaggcttggaaaagaaaaccaggttttaccaagcctccacctctgaattgtacggtttggtgcaagaaattccacaaaaggaaaccactccattctacccaagatccccatacgccgtcgctaagttgtacgcctactggatcaccgtcaattacagagaatcttacggtatgtacgcttgtaacggtatcttattcaaccacgaatccccaagacgtggtgaaaccttcgtcactagaaagatcaccagagccattgctaacattgctcaaggtttggaatcctgtttgtacttgggtaacatggactctttgagagactggggtcacgccaaggactacgttaagatgcaatggatgatgttgcaacaagaacaaccagaagatttcgttattgctacaggtgttcaatactctgtcagacaattcgtcgaaatggctgccgctcaattgggtatcaagttaagattcgaaggtactggtgtcgaagagaagggtattgttgtctcagttactggtcacgacgctccaggtgtcaagcctggtgacgtcatcattgctgttgatccaagatacttcagacccgctgaagttgaaactttgctaggtgacccaaccaaggcccacgaaaagttgggttggaagccagaaatcactttaagagaaatggtttctgaaatggtcgctaacgatttggaagctgccaagaaacactctttgctaaagtctcacggttacgacgttgccatcgctttggaaagttag

SEQ ID NO: 141 - DNA, 966 bp, Escherichia coli
atgtctaagcaaagagttttcatcgctggtcacagaggtatggtcggtagcgctatcaagagacaattggaacaaagaggcgacgtcgaattggtcttgagaaccagagatgaattgaacttgttagactcaagagctgttcacgacttctttgcctctgaatctatcgaccaagtttacctagctgccgctaaggtcggtggcatcgttgctaacaatacctacccagctgatttcatttaccaaaacatgatgatcgaatctaacatcattcacgctgcccaccaaaatgacgtcaacaaattgctattcttaggtagttcttgtatctaccctaagttggccaagcaaccaatggctgaatccgaattgctacaaggtactttggaaccaaccaacgaaccatacgctattgctaagatcgctggtatcaagttgtgtgaatcctacaacagacaatacggtagagactacagatccgtcatgccaaccaacttgtacggtccccacgacaacttccacccatccaactctcacgttatccctgccttgttaagacgtttccacgaagctaccgctcaaaacgctccagacgttgtcgtgtggggttctggtaccccaatgagagagttcttgcacgttgacgatatggctgccgcttctattcacgttatggaattagctcacgaagtttggttggaaaacactcaaccaatgttgtcccatatcaacgttggtactggtgtcgattgtactattagagaattggctcaaacaattgccaaggttgtcgattacaagggtagagttgtcttcgacgcttctaagccagacggtactccaagaaagttgctagacgtcaccagattgcaccaattgggttggtaccatgaaatctccttagaagctggtttggcctctacttaccaatggttcttggaaaaccgtgatcgtttcagaggttag

SEQ ID NO: 142 - DNA, 60 bp, artificial sequence
  primer
acgcaaaataacacagtcaaatcaatcaaaatgtctaaggttgctttgatcactggtgtt

SEQ ID NO: 143 - DNA, 60 bp, artificial sequence
  primer
tcataaatcataagaaattcgcttactcctaactttccaaagcgatggcaacgtcgtaac

SEQ ID NO: 144 - DNA, 60 bp, artificial sequence
  primer
ataaccataaccaagtaatacatattcaaatgtctaagcaaagagttttcatcgctggtc

SEQ ID NO: 145 - DNA, 60 bp, artificial sequence
  primer
aagatttaaagtaaattcacggccctgcaggctaacctctgaaacgatcacggttttcca

SEQ ID NO: 146 - DNA, 1713 bp, Saccharomyces cerevisiae
acctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 147 - DNA, 316 bp, Saccharomyces cerevisiae
gagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 148 - DNA, 725 bp, artificial sequence
  hybrid promoter PGK1(UAS)-FBA1
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 149 - DNA, 580 bp, Saccharomyces cerevisiae
gtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggataacgattctgaagttactcttagcgttcctatcggtacagccatcaaatcatgcctataaatcatgcctatatttgcgtgcagtcagtatcatctacatgaaaaaaactcccgcaatttcttatagaatacgttgaaaattaaatgtacgcgccaagataagataacatatatctagatgcagtaatatacacagattcccgcggacgtgggaaggaaaaaattagataacaaaatctgagtgatatggaaattccgctgtatagctcatatctttccct

SEQ ID NO: 150 - DNA, 20 bp, artificial sequence
  primer
gcagattgtactgagagtgc

SEQ ID NO: 151 - DNA, 20 bp, artificial sequence
  primer
gtgcggtatttcacaccgca

SEQ ID NO: 152 - DNA, 920 bp, artificial sequence
  coding sequence for a FutC enzyme from Helicobacter pylori with BsaI sites on ends
ggtctcaaggtatggctttcaaggttgttcaaatctgtggtggtttgggcaaccaaatgttccaatacgctttcgccaaatctttgcaaaagcacctaaacaccccagttttgttggatatcacctctttcgactggtccaacagaaagatgcaattggaattgttcccaatcgacttaccatacgcttctgccaaggaaattgctatcgccaaaatgcaacacttaccaaagttggtcagagataccttaaagtgtatgggtttcgacagagtttcccaagaaattgtcttcgagtacgaaccaggtttgctaaagccttccagattgacctacttttacggttacttccaagacccaagatacttcgatgctatttccccattgatcaagcaaactttcaccttgccacctcccgaaaatggcaacaacaagaagaaagaagaagaataccacagaaagttggctctaatcttagccgctaagaactctgttttcgtccacgtcagacgtggcgactacgttggtattggctgtcaattgggtatcgactaccaaaagaaggctttggaatacattgccaagagagtcccaaacatggaactatttgttttctgcgaagacttgaagttcactcaaaacttggacttgggttacccattcatggatatgactacaagagacaaggaagaagaggcttactgggatatgttgttaatgcaatcttgcaagcacggtatcatcgccaactccacttactcttggtgggccgcttacttgatcaacaatccagaaaagatcatcattggtccaaagcattggttgttcggtcacgaaaacattttgtgcaaagaatgggtcaagatcgagtctcacttcgaagtcaagtctaagaagtacaacgcctagtctagagagacc

SEQ ID NO: 153 - DNA, 22 bp, artificial sequence
  primer
gaatgtgctctagattccgatg

SEQ ID NO: 154 - DNA, 35 bp, artificial sequence
  primer
gatcagggatccgactcatctccatgcagttggac

SEQ ID NO: 155 - DNA, 34 bp, artificial sequence
  primer
gatcagtcgacgtatacgcgtatatttctaccaa

SEQ ID NO: 156 - DNA, 23 bp, artificial sequence
  primer
gtgaaattaataacagacatact

SEQ ID NO: 157 - DNA, 34 bp, artificial sequence
  primer
gatcaattaatgaactcgatttctgactgggttg

SEQ ID NO: 158 - DNA, 34 bp, artificial sequence
  primer
gatcaggtaccgtaaaagtcaaccccctgcgatg

SEQ ID NO: 159 - DNA, 2588 bp, artificial sequence
  trp1delta::URA3 integration cassette
  misc_feature (529)..(529): n is a, c, g, or t
attccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcggatcccccgggctgcaggaattcttggagaaattatcagagtctgatttcaatgagttaatgaaccaagagaagttcacagttattgaaattaaagagaaaggacaattggaaaaatttggaaggctaagatggacagttctaaaagattttataaaactgaaatgccccaagctattaagactacaggaaagacagtttctacagcaacaaaacgaagcatctttactcaatgaatctatggacgctctaaagatatcagaaaatgagaacaccaacgggagtgcaaataatagcacatacacnaatggcggacctcgaacatctatcaataatacaaggaattcgatatcaagctttttctttccaattttttttttttcgtcattatagaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagctagggagcccttgcatgacaattctgctaacatcaaaaggcctctaggttcctttgttacttcttccgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacaccacatatgcgtatatataccaatctaagtctgtgctccttccttcgttcttccttctgctcggagattaccgaatcaaaaaaatttcaaagaaaccggaatcaaaaaaaagaacaaaaaaaaaaaagatgaattgaaaagcttatcgataccgtcgacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatgaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatc

SEQ ID NO: 160 - DNA, 60 bp, artificial sequence
  primer
taaccaaataatacatattcaagtttaaacatgaaaaatatcatttcattggtaagcaag

SEQ ID NO: 161 - DNA, 60 bp, artificial sequence
  primer
atcataagaaattcgcttactcttaattaattaacatttatcagctgcatttaattctcg

SEQ ID NO: 162 - DNA, 604 bp, Saccharomyces cerevisiae
gcctacttggcttcacatacgttgcatacgacgatatagaaaataatgataatgacagcaggattatcgtataacgtaatagtcgaaaaatctcaaaaatctgtgggtcattacgtaaataatgataggaatgtgattcttctatttttcctttttccattctggcagccgtcgggaaaacgtggcttcctctctttcgggctctattggagtaacgctgccgtgagcttcctctctttccatatctaacaactgagcacgtaaccaatggtaaagcatgagcttagcgttgctccaaagaagtattggaaggttaataccatgtgtctgttctcttctgactttgactcctcaaataaaaaaaaattctacaatcaacagatcgcttcaattacgctctcacaaaaacttttttccttcttcttcgcccacgttaaattttaaccctcatgctgtctaacggatttctgcacttaatttattataaaacgacaaagacataatacttctctatcaatttcagttattgttcttcattgcattactcttctgttcttctttttcatttgtcatatacaaccataaccaaataatacatattcaa

SEQ ID NO: 163 - DNA, 3078 bp, Kluyveromyces lactis
atgtcttgtttgatcccagaaaacctaagaaatccaaagaaagttcacgaaaacagattgccaaccagggcttactactacgaccaagatatcttcgaatccttaaacggtccttgggcttttgccttattcgacgctcccttggatgctccagacgccaagaacttggattgggaaactgccaagaaatggtctactatttccgttccatctcactgggaactacaagaggactggaaatacggcaagccaatctacaccaacgtccaatacccaatacctatcgacattccaaaccctccgaccgtcaatccaactggtgtttacgctcgtactttcgaattggactccaagtctatcgaaagtttcgagcacagattgcgtttcgaaggtgtcgataactgttacgaattgtacgtcaacggtcaatacgttggcttcaacaagggttccagaaatggagccgaattcgatatacaaaagtacgtttccgagggcgaaaacttggttgttgtcaaagtgttcaagtggtccgactctacttacatcgaagaccaagatcaatggtggttatctggtatctacagagacgtctctttgttaaagctaccaaagaaagctcacatcgaagacgtcagagttacaaccactttcgtcgattctcaataccaagacgccgaattgtctgttaaggtggatgtccaaggcagttcttacgatcacatcaacttcaccttgtacgagccagaagacggttccaaagtttacgacgcttcttccttgctaaacgaagagaatggcaacaccactttttctacaaaggaattcatttccttttctaccaagaaaaacgaagagactgctttcaagatcaacgtcaaagctccagaacactggactgccgagaacccaaccttgtacaagtaccaactggatttgattggctccgacggttcagttattcaatctatcaagcaccatgtcggtttcagacaagtggaattgaaggatggcaatatcaccgtcaacggcaaggacatcttgttccgtggtgtcaacagacacgaccaccatccacgtttcggcagagctgtcccattggatttcgttgtcagagacttaatcttgatgaagaaattcaacatcaatgctgtcagaaactctcattacccaaatcaccccaaggtttacgatttgttcgacaagctgggtttttgggttatcgacgaagccgatttggagacccacggtgttcaagaaccattcaacagacacaccaatttggaagccgagtacccagacaccaagaacaaattgtacgacgtcaacgctcactacttgtccgacaacccagaatacgaggttgcttacttggacagagcctctcaattggttttacgtgacgtcaaccacccatccatcatcatttggtctttgggcaacgaagcctgttacggcagaaaccacaaggctatgtacaaactaatcaagcaactggacccaaccagattggttcactacgaaggcgacttaaacgctttgtctgccgacatcttctcctttatgtacccaaccttcgaaatcatggagcgttggagaaagaatcacaccgacgaaaacggcaagttcgagaaaccattgattctatgcgaatacggtcacgctatgggcaacggaccaggttctttgaaagagtaccaagaattgttttacaaagagaagttctaccaaggtggctttatctgggaatgggccaaccacggtatcgaattcgaggacgtttctactgccgatggcaagttgcacaaagcctacgcttacggtggcgatttcaaggaagaggtccacgacggtgttttcattatggacggtttgtgcaacagcgaacacaatccaactcctggtttggtcgaatacaagaaagttatcgaaccagtccacatcaagattgctcatggttctgttactatcaccaacaagcacgatttcattactacagaccacttgttattcatcgacaaagatactggcaagaccatcgacgttccgtctttgaagccagaagagtctgttaccattccatccgatactacatacgttgtcgctgtgttgaaggacgatgccggtgttttgaaggctggccacgaaattgcttggggtcaagccgaactacctttgaaggtcccagacttcgttaccgaaactgccgagaaagccgctaagatcaacgatggaaaaagatacgtttccgtcgaatcttcaggtttacacttcatcctggacaagttattgggcaaaatcgaatctttgaaggtcaagggaaaagaaatctcttccaagttcgaaggttcttcaattactttctggagaccacctaccaacaacgacgaaccaagagatttcaagaactggaagaaatacaatatcgacttgatgaagcaaaacattcacggagtttctgtcgaaaagggttccaacggctctttggctgtggttactgtcaacagcagaatttctccagttgtcttttactacggtttcgaaactgtccaaaagtacaccattttcgccaacaagatcaatttgaacacctctatgaagttaactggcgaataccaacctcccgacttcccaagagttggttacgaattctggttgggcgactcttacgaatccttcgagtggttgggcagaggtcctggagaatcttacccagacaaaaaggaatctcaaagattcggtttgtacgattccaaggacgtcgaggaattcgtttacgattacccacaagaaaacggaaatcacaccgatactcatttcttgaacatcaagtttgaaggtgctggcaagttatctatcttccaaaaggaaaaaccattcaacttcaagatttccgacgagtacggtgtcgatgaagccgctcacgcttgcgacgtcaagagatacggtcgtcactacctaagattggaccatgctattcacggtgttggctccgaagcctgtggtccagctgttttggaccaatacagactaaaggctcaagacttcaacttcgaatttgacttggctttcgaatag

SEQ ID NO: 164 - DNA, 1851 bp, Saccharomyces cerevisiae
atgaaaaatatcatttcattggtaagcaagaagaaggctgcctcaaaaaatgaggataaaaacatttctgagtcttcaagagatattgtaaaccaacaggaggttttcaatactgaagattttgaagaagggaaaaaggatagtgcctttgagctagaccacttagagttcaccaccaattcagcccagttaggagattctgacgaagataacgagaatgtgattaatgagatgaacgctactgatgatgcaaatgaagctaacagcgaggaaaaaagcatgactttgaagcaggcgttgctaaaatatccaaaagcagccctgtggtccatattagtgtctactaccctggttatggaaggttatgataccgcactactgagcgcactgtatgccctgccagtttttcagagaaaattcggtactttgaacggggagggttcttacgaaattacttcccaatggcagattggtttaaacatgtgtgtcctttgtggtgagatgattggtttgcaaatcacgacttatatggttgaatttatggggaatcgttatacgatgattacagcacttggtttgttaactgcttatatctttatcctctactactgtaaaagtttagctatgattgctgtgggacaaattctctcagctataccatggggttgtttccaaagtttggctgttacttatgcttcggaagtttgccctttagcattaagatattacatgaccagttactccaacatttgttggttatttggtcaaatcttcgcctctggtattatgaaaaactcacaagagaatttagggaactccgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaagttgatcttactttaaagcagattgaattgactattgaaaaagaaagacttttagcatctaaatcaggatcattctttaattgtttcaagggagttaatggaagaagaacgagacttgcatgtttaacttgggtagctcaaaatagtagcggtgccgttttacttggttactcgacatatttttttgaaagagcaggtatggccaccgacaaggcgtttactttttctctaattcagtactgtcttgggttagcgggtacactttgctcctgggtaatatctggccgtgttggtagatggacaatactgacctatggtcttgcatttcaaatggtctgcttatttattattggtggaatgggttttggttctggaagcagcgctagtaatggtgccggtggtttattgctggctttatcattcttttacaatgctggtatcggtgcagttgtttactgtatcgttgctgaaattccatcagcggagttgagaactaagactatagtgctggcccgtatttgctacaatctcatggccgttattaacgctatattaacgccctatatgctaaacgtgagcgattggaactggggtgccaaaactggtctatactggggtggtttcacagcagtcactttagcttgggtcatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaa

SEQ ID NO: 165 - DNA, 7705 bp, artificial sequence
  plmH101 plasmid
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcggccgcggcgcgccgcctacttggcttcacatacgttgcatacgacgatatagaaaataatgataatgacagcaggattatcgtataacgtaatagtcgaaaaatctcaaaaatctgtgggtcattacgtaaataatgataggaatgtgattcttctatttttcctttttccattctggcagccgtcgggaaaacgtggcttcctctctttcgggctctattggagtaacgctgccgtgagcttcctctctttccatatctaacaactgagcacgtaaccaatggtaaagcatgagcttagcgttgctccaaagaagtattggaaggttaataccatgtgtctgttctcttctgactttgactcctcaaataaaaaaaaattctacaatcaacagatcgcttcaattacgctctcacaaaaacttttttccttcttcttcgcccacgttaaattttaaccctcatgctgtctaacggatttctgcacttaatttattataaaacgacaaagacataatacttctctatcaatttcagttattgttcttcattgcattactcttctgttcttctttttcatttgtcatatacaaccataaccaaataatacatattcaagtttaaacatgaaaaatatcatttcattggtaagcaagaagaaggctgcctcaaaaaatgaggataaaaacatttctgagtcttcaagagatattgtaaaccaacaggaggttttcaatactgaagattttgaagaagggaaaaaggatagtgcctttgagctagaccacttagagttcaccaccaattcagcccagttaggagattctgacgaagataacgagaatgtgattaatgagatgaacgctactgatgatgcaaatgaagctaacagcgaggaaaaaagcatgactttgaagcaggcgttgctaaaatatccaaaagcagccctgtggtccatattagtgtctactaccctggttatggaaggttatgataccgcactactgagcgcactgtatgccctgccagtttttcagagaaaattcggtactttgaacggggagggttcttacgaaattacttcccaatggcagattggtttaaacatgtgtgtcctttgtggtgagatgattggtttgcaaatcacgacttatatggttgaatttatggggaatcgttatacgatgattacagcacttggtttgttaactgcttatatctttatcctctactactgtaaaagtttagctatgattgctgtgggacaaattctctcagctataccatggggttgtttccaaagtttggctgttacttatgcttcggaagtttgccctttagcattaagatattacatgaccagttactccaacatttgttggttatttggtcaaatcttcgcctctggtattatgaaaaactcacaagagaatttagggaactccgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaagttgatcttactttaaagcagattgaattgactattgaaaaagaaagacttttagcatctaaatcaggatcattctttaattgtttcaagggagttaatggaagaagaacgagacttgcatgtttaacttgggtagctcaaaatagtagcggtgccgttttacttggttactcgacatatttttttgaaagagcaggtatggccaccgacaaggcgtttactttttctctaattcagtactgtcttgggttagcgggtacactttgctcctgggtaatatctggccgtgttggtagatggacaatactgacctatggtcttgcatttcaaatggtctgcttatttattattggtggaatgggttttggttctggaagcagcgctagtaatggtgccggtggtttattgctggctttatcattcttttacaatgctggtatcggtgcagttgtttactgtatcgttgctgaaattccatcagcggagttgagaactaagactatagtgctggcccgtatttgctacaatctcatggccgttattaacgctatattaacgccctatatgctaaacgtgagcgattggaactggggtgccaaaactggtctatactggggtggtttcacagcagtcactttagcttgggtcatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtcgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 166 - DNA, 1179 bp, artificial sequence
  E coli SetASc codon optimized coding sequence
atgatctggattatgactatggctagacgtatgaacggtgtttacgccgctttcatgctagttgcctttatgatgggcgttgccggtgctttgcaagctccaaccttatccctattcttgtctagagaagtcggtgctcaacccttttggatcggtttgttctacaccgtcaacgccatcgctggcattggtgtttctttatggttggccaagagatccgattctcaaggcgacagaagaaagttgatcattttctgttgtttgatggccatcggcaatgctttgctatttgccttcaacagacactacttaactttgatcacctgtggtgttttgttggcttctttggccaataccgctatgccacaactattcgctttggccagagaatacgccgacaactctgccagagaagttgttatgttctcttccgtcatgcgtgcccaactatctttggcttgggtcatcggtccacctttggccttcatgttggctctaaactacggttttactgtcatgttctctatagccgctggtatcttcaccttatctttggttctaattgctttcatgttgccatctgttgccagagtcgagttgccatccgaaaacgctttgtctatgcaaggtggctggcaagattccaacgtcagaatgttgttcgttgcttctactttgatgtggacctgcaacactatgtacatcatcgacatgccattgtggatctcttccgaattgggtttaccagacaagttggctggtttcttaatgggcactgccgctggtttggaaattccagccatgatcttagctggttactacgtcaaacgttacggcaagagaagaatgatggtcatcgctgttgccgctggcgtcttgttttacaccggcttaatcttcttcaactccagaatggctctaatgaccttacaattgttcaacgctgtctttatcggtattgttgctggcatcggtatgttatggttccaagatttgatgccaggcagagctggtgccgctaccactttgttcacaaactccatttctactggtgttatcttggctggcgtcattcaaggtgccatcgctcaatcttggggtcacttcgctgtctactgggttatcgctgtcatttccgttgttgctctattcttgaccgccaaggtcaaggacgtttag

SEQ ID NO: 167 - DNA, 3108 bp, artificial sequence
  Acinetobacter baumanii AdeB codon optimized coding sequence
atgtcccaattcttcattagaagaccagttttcgcttgggtcatcgctatcttcattatcatcttcggtttgttgtctattccaaagttgccaatcgctagattcccatctgttgctccaccacaagtcaacatctccgctacttacccaggtgctaccgctaaaaccatcaacgactctgttgttaccttgatcgaaagagaattgtctggtgtcaaaaacttgttatactactccgctaccactgacacttctggtaccgccgaaatcaccgctaccttcaagccaggtactgatgttgaaatggcccaagtcgatgttcaaaacaagatcaaggctgttgaagctagattgccacaagttgttagacaacaaggtttgcaagttgaggcttcttcctctggtttcttgatgttggttggtatcaattctccaaacaaccaatactccgaagtcgacttatctgactacctagtcagaaacgtcgttgaagagttgaagagagtcgaaggtgttggtaaggtgcaatctttcggtgccgaaaaggctatgagaatatgggttgatccaaataagctagtttcttacggtttgtccatttctgacgtcaacaatgccattagagaaaacaacgtcgaaatcgctccaggtagattgggtgacttgccagctgaaaagggtcaattgatcacaattccactgtctgctcaaggtcaattgagctccttggaacaatttaagaatattagtttgaagtctaagactaacggttctgttatcaagttgtccgacgttgctaacgttgaaattggttctcaagcttacaacttcgctattttggaaaacggtaagccagccactgctgctgctatccaattgtcccctggtgccaacgccgtcaagactgctgaagtcgttagagctaagatcgaagaattaaagctaaacttgccagaaggtatggaattctctatcccatacgacaccgctccattcgtgaagatatcaattgaaaaggttattcacaccctattagaagctatggtgctagtcttcattgtcatgtacttgttcttgcacaacgttagatacaccttgatcccagccatcgtcgcccctatcgctttgttgggtacattcaccgtcatgttattagccggtttctccattaacgtcttaaccatgttcggtatggtattagctatcggtatcatcgtcgacgatgctatcgtcgtcgttgaaaacgtcgaaaggattatggctaccgaaggtttgtctccaaaggatgctaccagcaaggctatgaaggaaatcacttctccaatcattggtatcaccttggtcttggctgctgttttcttgccaatggctttcgcttctggttccgttggtgttatctacaagcaatttaccctaaccatgtccgtttctatcttgttctccgctttattggctttgatcttaactccagctttgtgtgccaccatcttgaagcccatcgatggacaccatcaaaaaaagggtttcttcgcctggttcgatcgttctttcgacaaggttaccaagaagtacgaattgatgttgttgaagattatcaaacacactgtcccaatgatggttatcttcttggtcatcactggtatcacctttactggtatgaagtactggccaaccgcctttatgccagaagaagaccaaggctggttcatgactagtttccaattgccttccgatgctaccgctgaaagaaccagaaacgtcgtcaaccaattcgaaaacaacttgaaggacaacccagacgttaagtctaacactaccatcttgggctggggtttctcaggtgctggtcaaaacgtcgctgtcgcctttacaactttgaaggacttcaaggaaagaacttcttccgcctctaagatgacttctgacgtcaactcctctatggccaactccactgaaggcgaaactatggctgttttgccacctgctattgatgaattgggtaccttctctggtttctccctaagattgcaagacagagctaacttgggtatgcccgctttgttggctgctcaagatgaactaatggccatggccgctaagaacaagaagttctacatggtctggaacgaaggtttgccacaaggtgacaacatttctttgaagatcgacagagaaaagttatctgctttcggtgttaagttctctgatgtttctgacattatctctacttctatgggttccatgtacattaacgacttcccaaaccaaggtagaatgcaacaagttatagttcaagtcgaggccaaatcccgtatgcaactaaaggacatcttgaatttgaaggttatgggttcctctggtcaattggtctctttgtctgaagtcgtcacccctcaatggaataaagctccacaacaatacaaccgttacaacggtagaccaagtttgtccatcgctggtattccaaacttcgacacttcctctggtgaagccatgcgtgaaatggaacaattgattgccaagttaccaaagggtatcggttacgaatggaccggtatttccttacaagaaaagcaatctgaatctcaaatggctttcttgttaggcctatctatgttagttgtcttcttggttttagccgccttgtacgaatcatgggctatccctttgtctgttatgttggtcgttccgttgggtattttcggtgctatcatcgctatcatgtctagaggtctaatgaacgacgttttcttcaagatcggtctaatcactatcattggtttgtccgctaagaacgctatcttgatcgttgaatttgctaagatgttgaaggaagaaggtatgtccttaattgaagccaccgtcgctgccgccaagttgagattgagaccaatcttgatgacttccttggctttcacttgtggtgttatcccattggtcattgctagcggtgcttcctctgaaacccaacacgccttgggtactggtgtcttcggtggcatgatctccgctactatcctagctatcttcttcgtcccagttttcttcatcttcatcttgggtgctgttgaaaagttgttctcttctaagaaaaagatttcttcctga

SEQ ID NO: 168 - DNA, 3114 bp, artificial sequence
  E.coli AcrD codon optimized coding sequence
atggctaacttcttcattgacagacctatcttcgcttgggtcttggctatcttactatgtttgactggtaccttggctatcttctctttgccagttgaacaatacccagacttggctccaccaaacgttagagtcactgccaattacccaggtgcctctgctcaaaccttagaaaacactgttacccaagtcattgaacaaaacatgactggtctggacaacttgatgtacatgtcttctcaatcttccggtactggtcaagcttccgttaccttgtctttcaaggctggtactgatccagacgaagctgttcaacaagttcaaaaccaattgcaatctgccatgagaaagttaccacaagctgttcaaaaccaaggtgtaaccgttagaaagactggtgacaccaacatcttgaccattgctttcgtttccactgatggtagcatggacaagcaagatatcgctgactacgttgcttctaacattcaagacccgttatctagagtcaacggtgtgggtgacattgatgcctacggtagtcaatactctatgagaatctggttagacccagccaagttgaactctttccaaatgactgccaaggacgttaccgacgctatcgaatcacaaaacgctcaaatcgctgttggtcaattgggtggcactccatccgttgacaagcaagccttgaatgccaccatcaatgctcaaagcttgttgcaaactccagaacaattcagagacatcaccttgagagtcaaccaagacggttctgaagttagattgggtgacgttgctactgttgaaatgggtgctgaaaagtacgattacttgtctcgtttcaacggtaagccagcttctggtttgggtgtcaagctagcttccggtgctaacgaaatggctacagctgaactagtcttgaacagactagatgaattggctcaatactttccacacggtttggaatacaaggttgcctacgaaaccacttccttcgtcaaggcttctatcgaagacgttgtcaagaccttgttggaagccattgccttagtcttcttagtcatgtacttgttcttacaaaacttcagagctaccttgattccaaccattgctgtgccagttgtcttgatgggtaccttctccgtcttgtacgctttcggttacagtgtcaacaccttgactatgttcgctatggtcttagccattggtttgctagttgacgacgctatcgtcgttgtcgaaaacgttgaaagaatcatgtccgaagaaggcttaactcctagagaagctaccagaaagtctatgggtcaaatccaaggtgctttggttggcatagccatggtcttgtccgctgtcttcgttccaatggctttctttggtggcaccacaggtgccatctacagacaattctctatcaccattgtggctgccatggtcttgtctgtcttagttgctatgatcttgactccagccttgtgcgctaccttgttgaagccattgaagaagggtgaacaccacggtcaaaagggtttctttgcttggttcaaccaaatgttcaacagaaatgctgaaaggtacgagaagggtgttgccaaaatcttgcacagatccttgagatggattgtcatctacgtcttgttgttaggtggaatggtcttcttgttcttacgtttgccaacctccttcttgccactagaagacagaggtatgttcaccacttccgttcaactaccatctggttccactcaacaacaaaccttgaaggttgtagaacaaatcgaaaagtactacttcactcacgaaaaagacaacatcatgtctgtcttcgctactgttggttccggtccaggtggcaacggtcaaaacgttgccagaatgttcattcgtttgaaggattggtctgaaagagattctaagactggtacctctttcgctatcattgaaagagctaccaaggctttcaaccaaatcaaggaagctagagtcatcgcttcttctcctccagccatctccggtctaggttcctccgctggtttcgacatggaactacaagaccacgctggtgctggtcacgatgccttgatggctgccagaaatcaattgttagccttggctgctgaaaacccagaactaaccagagttcgtcacaacggtttggatgactccccacaactacaaatcgacattgaccaaagaaaggctcaagccttgggtgttgccattgatgatatcaacgataccttgcaaactgcttggggttcatcctacgtcaacgacttcatggacagaggtcgtgtcaagaaggtctacgttcaagctgctgctccatacagaatgttgcctgatgacatcaacttgtggtacgtcagaaacaaggatggtggcatggttccattctcagccttcgctacctctagatgggaaactggttcccctagattggaaagatacaacggttactctgctgttgagatagttggtgaagctgctccaggtgtttccacaggtactgctatggacatcatggaatctttggtcaaacaactacctaacggtttcggtttggaatggactgctatgtcttaccaagaaagattgtctggtgctcaagctccagccttgtacgctatctctttgttagttgtcttcttgtgtttagctgccttgtacgaatcttggtccgttccattctctgtcatgttggttgtcccactaggtgtcattggtgccttgttagctacttggatgagaggtctagaaaacgatgtctacttccaagttggtttgttgaccgtcattggtttgtctgccaaaaacgctatcttgattgtcgaattcgccaatgagatgaaccaaaagggtcatgacttgttcgaagctaccttgcacgcttgtagacaacgtttgagacccatcttgatgacctctttggctttcatctttggtgtcttgccaatggctacctccactggtgctggttctggtggtcaacacgctgttggtactggtgtcatgggtggcatgatctctgccaccatcttggctatctactttgttccattgttctttgtcttggttagacgtagattcccattgaagccaagacccgaatga

SEQ ID NO: 169 - DNA, 744 bp, artificial sequence
  At Sweet1 codon optimized coding sequence
atgaacattgctcacaccatcttcggtgtttttggcaacgctactgccttgttcttattcttggctccatctattaccttcaagagaatcatcaaaaacaagtccaccgaacaattctctggtatcccttacccaatgactttgctaaactgtttgttatctgcttggtacggtttaccattcgtctccaaggacaacacattggtttccaccatcaatggtactggtgctgttatcgaaactgtctacgttttgatctttctattctacgctccaaagaaagaaaagatcaagattttcggtatcttttcctgtgtcttggctgttttcgccactgtcgctttggtttctctattcgctttgcaaggcaacggcagaaagttgttctgcggtttagccgctaccgtcttctctatcattatgtacgcctctccattatccattatgcgtttggttgtcaaaaccaagtctgtcgagtttatgccattcttcttgtctctatttgttttcttgtgtggtacttcttggttcgtctacggtttgatcggcagagatccattcgttgctatccccaacggtttcggctgtgctttgggtaccttacaattgattctatacttcatctactgtggcaacaaaggcgaaaagtctgccgatgctcaaaaggacgagaaatccgtcgaaatgaaggacgacgaaaagaaacaaaatgttgtcaacggtaagcaagacttgcaagtttag

SEQ ID NO: 170 - DNA, 756 bp, artificial sequence
  At Sweet4 codon optimized coding sequence
atggtcaacgccaccgttgctagaaacatcgctggtatttgtggcaacgttatctctttgttcctattcttatctccaatccctaccttcattactatctacaagaagaagaaagtcgaagaatacaaggccgacccatacttggccactgtcttaaactgcgctttgtgggttttctacggtttgccaatggttcaacccgattctttgttggtcattaccatcaacggtactggtttggccatcgaattggtttacttggctatcttcttctttttctctccaacttccagaaaggtcaaggttggtttgtggttaatcggcgaaatggttttcgttggtatcgtcgctacttgtaccttgttgttattccacacccacaaccaacgttcttccttcgtcggtatcttttgtgtcattttcgtttctttgatgtacatcgctccattgaccattatgtccaaagttatcaagacaaagtctgtcaaatacatgccattctctttatccttggccaatttcttaaacggtgttgtttgggtcatttacgctctaatcaagttcgatttgttcatcctaattggcaacggtttgggtactgtttctggtgctgtccaattgatcctatacgcttgttactacaagaccactccaaaggacgacgaagacgaagaggacgaagaaaacttgtccaaggtcaattctcaattacaattgtccggcaactctggtcaagctaagagagtttccgcttag

SEQ ID NO: 171 - DNA, 870 bp, artificial sequence
  At Sweet10 codon optimized coding sequence
atggctatttctcaagccgtcttggctaccgttttcggtatcttgggcaacatcatttccttctttgtttgtttggctcctattccaaccttcgtcagaatctacaagagaaaatcttccgaaggttaccaatctatcccatacgtcatttccctattctctgctatgttgtggatgtactacgctatgatcaagaaagacgccatgatgttgattaccatcaactcttttgctttcgttgtccaaattgtttacatctctttgttcttcttctacgctccaaagaaagaaaagaccttaactgtcaagtttgttctattcgtcgatgtcttgggtttcggtgctatctttgtcttgacttacttcatcattcacgccaacaagagagtccaagttttgggttacatttgtatggtctttgctctatctgttttcgtcgctccattgggtatcatcagaaaagttatcaagaccaagtctgccgagttcatgccatttggtttgtctttcttcttaactttgtccgctgttatgtggttcttttacggtttgttactaaaggacatgaacatcgctttaccaaatgttttgggcttcatctttggtgtcttgcaaatgatcttattcttgatttacaagaaaccaggtaccaaggttttggaaccacccggtatcaagttgcaagacatttccgaacacgttgtcgatgttgtcagattgtccactatggtttgcaactctcaaatgcgtactttggttccacaagattctgccgacatggaagctacaatcgacatcgacgaaaagatcaaaggcgatatcgaaaagaacaaagacgagaaggaagttttcttgatctccaagaactag

SEQ ID NO: 172 - DNA, 870 bp, artificial sequence
  At Sweet11 codon optimized coding sequence
atgtccttgttcaacaccgaaaacacctgggctttcgtttttggtttgttgggcaacttaatctcctttgctgtcttcttgtctccagttcctaccttctacagaatttggaagaagaaaaccacagaaggtttccaatctattccatacgttgtcgctttgttctctgccactttatggttgtactacgctactcaaaagaaagacgttttcttgttggtcaccatcaacgcttttggttgtttcatcgaaaccatctacatttctatgttcttggcctacgctccaaagcctgccagaatgttaaccgtcaagatgttgttactaatgaactttggtggtttctgtgctatcttgctactatgtcaattcttggtcaagggtgctactcgtgccaagatcattggtggtatttgtgttggcttctctgtctgtgtttttgccgctccattgtccatcatcagaactgttatcaagaccagatccgtcgaatacatgccattctccttgtctctaactttaaccatttctgctgttatctggttgttatacggtttggctctaaaggatatctacgttgctttcccaaatgtcttgggtttcgctttgggtgccttacaaatgattttgtacgttgtttacaagtactgcaaaacttctccacacttgggcgaaaaggaggtcgaagccgctaagttaccagaagtttctttggatatgttaaagttgggtactgtctcttccccagaacccatctctgttgtcagacaagccaacaagtgtacttgtggcaacgacagaagagccgaaatcgaagacggtcaaaccccaaagcacggcaagcaatcctcttctgccgccgctacttag

SEQ ID NO: 173 - DNA, 669 bp, artificial sequence
  Batrachochytrium dendrobatidis codon optimized coding sequence
atgaccttgttagaatggtgtgctatcttgctaaccgttggtatgttcttgaccaatttcaacactttacgtttgtacatgcgtactggtaccacaggtcacgctactactattccattcgtctgtactttactaaactgttctttgtggttcagatacggtttgttggttcaattgacttctttggttatcgtcaacgctgttggtatcctagtctctattgtttccttgtacgtcttctgcaagtacaccgacagacaatccgatgctcaaatcccaatcattaccgctttgggtttcctatacttggtcttcgtctacgttcacttggtttctggttccgccatgttgaagcaatacggcttcttgactgctaccttttctatcttcatgtacggtgctccattgttatctttggccaacgtcatccaattgaagtctgctactggtttgatctccttaccaatgacttgtatctctttgattgtttgttgtttatggaccgccttcggttaccaaattcaagacaacttcgttttgatcccaaacaccattggtggtatcttatgtttgttccaactaattgtcttgcgtatctacccagacgaaaagaacggttacaccatccaccaaccttccttgccaatgtctgacagaagatcctactag

SEQ ID NO: 174 - DNA, 702 bp, artificial sequence
  Batrachochytrium dendrobatidis codon optimized coding sequence
atgtctaccatcgaatgttccactccaaactgccaattggttttacaccatatcattcctatcatcggtgttttcaccgctttatggatcttcattgctccattcaagtctgtcaagagattgggcaactccgacaatttggaaaacgtcaaccccttgccattccctatgatcgtcgccaattgtttgggttggttggtctacggtttactaattcaagacatctacgtcatcattccaaacatcattggttaccaatttggtatctactacaccttgatggcttacagaattgccgctccagagttccaatccagagctttgcaaatcctaattggttcttctttgttggttttcattggtggcgtcttgggtttcatcgttctacaaggcaacgaagctggcagaatcgttatgggtttggtctgtgttgttatcttggctgtcttctactgttctccattgtccgatttctacaacgttatcaagaagaaagatgcttcttccatcgacgtttacctagccgccgcttctttggtcaacggttccttatggactgtttacggtttcgctattggcgacactttcatctggtccccaaacttgttgggtgttgtcttatctttggttcaattcgtcttgttggccatcttcgctcgtccaaagtctcacgaatttcaagttttgagaaacgctacctag

SEQ ID NO: 175 - DNA, 711 bp, artificial sequence
  Batrachochytrium dendrobatidis codon optimized coding sequence
atgtctgccatcgttatgaaccacgtcttgccagctttgggtgttgccttcgctatttccatctacttgtctccattcacccatgtttggaagtctttgaaaaacaaggaagcctctttggtcaacactatgccatacccttggatcattgccaactgtttgggttggattgtttacggttgtcacactggcgactactacgttttcgtcgccaacatcgttggttaccacttgggtctattctacaccttgtcttctttacactacggttccgacaagttcagaaccactgccgctgttatcgtcttgggttcttccttcttggtcttaacctctgcttttgttgtcttcgccatcttgcgtcaagctcaaccatccaagactgttttgggttccgtctgtgttttcattttggtcatcttctacgcttctccattatccgatttggcttctgttatcagatccagagacgcttcttctatcaacccaattctaggtttctgctctttgttaaacggtgctctatggactggctacggtttcgctatctccgatccattcatttgggctcccaacgtcgtcggtgttgttctatctatcgtccaattgtttctatgtttcttattcagaggcaacaagtctacagtcaattcccaaggtactttgccaacctccaaggctttggaagctgaataccaccactccacctag

SEQ ID NO: 176 - DNA, 702 bp, artificial sequence
  Rozella allomycis codon optimized coding sequence
atggctgatttcttgttaggtcaaattgttccagctttgggtgcttgtatttctatctttttgttcttatctccaatgaaggctttcatggttcactccaccaagtacgacttcaacccattagccgctattaccatgatcttaaactgcttgtcttggattttctacggcatcttcgtcaaggacatttacatcatcactccaaacgttcccggtttgactctatctgtttggtacactgtcaacgtttaccaccacggtgtcgccaacaatcctcaaagaaagtactacgacgccattttggtcttgggtatcttcttaatcttgttggtcgattctgccatcgctccacaattgttggacgttgccgccgctcaaactatggctggttacatgtgtatcattatgttgttattcttttacatctctccattatccaccttggccaactgtgtcaaggaaaagtctgctgtttccatccatttcggtttatccgttgcttctttggtcaacggtttactatggaccgtttacggtatcgctattcaagacgctttcgtctacggtccaaacttcgttggttgtttgtccgcttctgtccaattgttactaaagttcatctacagaaaatccgacaaggctttactaccattgagaaacatcgaaaaggattctttggactctgccgaaatcgcttcctag

SEQ ID NO: 177 - DNA, 696 bp, artificial sequence
  Albugo Candida codon optimized coding sequence
atggaaaacgtcttcttggtttctaccttgctaatgacaaagtctatcccagttattgccgctggttcttccttaatcttcgctatttctccaatgaccactacaagatccatccaacgtgccaagtccactttgcaatacccttttgctccattcttctttttcttcattcaaaatgtcatcactttgttatacgcttacgccacctggaaccacatcatcgctttgactgccgctttatcttcctccttgggtgcttactacgtctacatctactacaagcactccaaacaaaagacccacccaagacgtatgttgggtattgcttgtttcggcatcttgttgttggccgtcaacgctctacccagagaaccagaagacgctcaatggatcattggtgttccatctttgattctatccatcttaacttcttcttccccattgatgcaaatcagagacattttgaagagaaaggacgcttcttgtttgccattcggtatgtctgttatgaacttgatctctggttccgtctggaccttgtacggttctatcctaaaagatcctttgatcattgttccaaacatcattgctttgtctatgggtatcgttcaagtctctttgatcttcttatacccatccaagtctaccagaaaggccaactgggaatccgacggtggtatcgaaagagctgattag

SEQ ID NO: 178 - DNA, 714 bp, artificial sequence
  Albugo Candida codon optimized coding sequence
atgtccacctggcaatctatggaaaacgttttcttggtttctactttactaatgaccaagtccatcccagtcattgccgctggttcttccttaatcttcgctatttctccaatgaccactacaagatccatccaacgtgccaagtctactttgcaataccctttcgctccattcttctttttctttatccaaaatgtcattaccttgttatacgcctacgctacttggaaccacatcatcgctttgactgccgctctatcttcctccttgggtgcttactacgtctacatctactacaagcactccaaacaaaagacccacccaagacgtatgttgggtattgcttgtttcggcatcttgttgttggctgtcaacgccttaccaagagaaccagaagacgctcaatggatcattggtgtcccatctttgattctatccatcttaacctcttcttcccctttgatgcaaatcagagacattttgaagagaaaggatgcttcttgtttgccattcggtatgtctgttatgaacttgatctctggttccgtttggactttgtacggttctatcttaaaggacccattgatcattgttcccaacatcattgctttgtctatgggtatcgtccaagtttctttgatcttcctatacccatccaaatctaccagaaaggccaactgggaatctgacggtggtatcgaaagagctgattag

SEQ ID NO: 179 - DNA, 675 bp, artificial sequence
  Albugo Candida codon optimized coding sequence
atgtcttccttgtacttattcgcttctccattcgccgacatcagagctattcaagccgctaagatcaagcactccagacgtatcttaccattgacctctatgttctgcaacgctatctgttggtgtctatacggtatcttggctcacaacattttccctttgttgttaaccaacgctgttggtatcatcatcgtcacttactacttgtacattttctccaagtacgcttccgactctgttcacgtcagaaagtgtttgattggtatggctgttactttgtccattttcttctctttttgtttgttcgctccagtctctcacgctactgttcaatctgttgtcggctacactggtatttctgtctgtaccgttatgttcgcctctccattggctgttgtcaagaaagtcatcgccgaaaagtcttccgatatgttgccattccccatgatcgttgccgcctttatgaactctatcttatggttggtctacggtctaatgatccacgacatcattgtcttcttgccaaatctaatcaacttcttcttggctggtatgcaactatctttgttcgttatctacccaagaaccaagggttacgtttctatgcattcttccgttgctatcatggatgccaagattttcgtcccagtttcctctgacttggaaaaggcctag

SEQ ID NO: 180 - DNA, 543 bp, artificial sequence
  Albugo Candida codon optimized coding sequence
atggcttctgttttagccttctgtatgtgtttgtctcctatcccagacatgattcacatccaaaaggaaagatccaccgactctctaccattgttatccttggtcgctctatggatcaactgtcacgtctgcgccatgtctatcgtttacttggtcatttaccaaaagtacgcttactgtcacaccagagttttgctatccaacttatgtgctttcatcttgaacatttgcttaactatcttcgcttgtacaggttcttctattgtttcccaagaaaccttggtcaagtgttttggttacatcgccaacgtttctggcttgttactatacggttctccattgatcaacgttgtcgaagctgtccaagccaagaacgctacttccattccaatcgctatgactgttgtcggtttggccaacaatgctacctggatcttgtacggtttcttaatcgacgatatctacttgattgctccatgtgttatcaacactatggtctgtttgattcaactattcgtctgtgctgttttgcaattgacctag

SEQ ID NO: 181 - DNA, 1200 bp, artificial sequence
  Bacillus subtilis codon optimized coding sequence
atgcacaacttgcaagttagaagacactacgccgctttgaagggtttctacttattcgcctttttgggtaccggctctatcattccattactatccatgtacttgaccaaggaacaacacttgtctggttcccaagttggcttaatcatgtctttgggtcctattgttatgatcttctttcaaccattctggggtatgttgtccgattacactcaaaagaccaagggtttgttggctgtctgtacttctatcaccggcatcattggtttggcctacatcgctttcgactcttttcctttgttcatcctaattgccgcttgttttgccgctttccaatctaccatcattccactatccgattctatttctttgcgttacacccaagaaacaaacggcaactacggtggtatcagactattcggctctttgggttttggtgttgccgtcttcgctatgggtcaagttaccaaccaattgtacccaattcacgttatcttcatctttggttgtgctttcttgtgcattgccgctatcttggcttctcaagttccaggtcaacaaaagactacaaaagtcaacatcagaaagggtttcagagaattgatctccaacaagactttcttgatctttatgatcattaccttcactacatttgctccaaacttggccaacaatacttacttctccttattcttggacaagtctggtgcttccttgtctgccattggtatcttgttctttatcggtgtcatttccgaaatcccattcatgcgttttgctcaaactttcatcgacaagatgggtttgttaaacgttatcatgttgtctggtggcgtttccttattcagatgggccttgtacttcaccgctccatctttgtggatcatttacgctactgtcttcttgcaaggcgttgctatcggtttgttcattccagccgctttgcaatacgtcaagaagatcactcccagacacgtcgaagccactgctttgaccatgtacgccgctatcggcaacggtttcggcaattggttttgtactttcgctggtggctacatcttcgactacgtttctatcttcgctgtctacttgttattcggtatcctatctattgctggtttcggcttaactttgtacctaatgaaggccgaaaagaacaaacataccttgcaccaaccagctgtcaccttcaagccatag

SEQ ID NO: 182 - DNA, 1179 bp, artificial sequence
  Bacillus subtilis codon optimized coding sequence
atgtggttggctaacttcttcgtttctgcttccaccactatgatcgttccattcttatctttgtacatcgaaaccttatcttctttctccaatggttttgttcaaagatggtctggctacgttttcggtatcacctttctaatggctttcttggtttctccattttggggtcgtttcggcgacaaaagaggttacaagaagattttgatggctacaggtactggcattgctttgtctatcttctttatgggtttcgtcacctctgtttaccaattgttctttctacgtatggctatgggcttggtcactggtttcatcccaacctctttggccatgatctccgctcaaaccccaaagtcttccgctggcaagaccttgggtactttacaaatgggtcaagtctccggctctctattcggtccattgttgggtggcatgttggccgacagattcggttttacctacactttcttcattacctcctttgtcatcttctcttccgttttgttggtcttattcggtgtcaaggaaaaacacttggccgaaaagactgccaagagaacctcttactccagaaaggaagtcttgtcttacatcttccaccacccagctttatgggttatgatgttgttaactatgctaattcaaaccggcaacttctctatccaaccattgttggctctatacgtcaacgaattgcatggtcctgtcaacttggctttcttttctggtatggccttctccgctactggtttgggctccttgttgttggccagaaagtggggtgatttgggcgatcgttacggtcacagaagaatcctaattggtttgttgttagccgcttctttcttctttatcccacaagccttggcttcttccttatctgtcttgttggttttcagattcctatttggcatggctatgggtggtttgttaccatgtattactgccgctatcagagttcaagccccaggttctattcaaggcgaagttttgggttacaacgtctctttcagattcttgggcaacgttttgggtcctttgttgggtggtatcatttcttcccacttcactatctctgctaccttttacgttactgctttcttgttctttgccggtgcttgtatgttgtggatcatgcaaaagttgagaaaggactcctacgccaaggcttcttag

SEQ ID NO: 183 - DNA, 1686 bp, artificial sequence
  Mucor circinelloides codon optimized coding sequence
atgccatacttggctccaaagttgttatacaccttcctatttgcctgtcaaggttctgctccagtttacttggccttattctactcttcccaattgggtctaaagggcgaccaaatcggtttgttggtcgccatcgctccattcatttctgccatcgcttgtccattgtgggccgctattgccgacaaaacaaagacccactcttacatcatgtgtattgttcacaccttggccactatcgctattgtttctgtcatgggtatttccgttgtcgtccaaccaatcgttgacgaagttgacagaaacaagttaactatcgctttggtcaccgtcacttctgtttgttttgctttcttcggtgtccctgttttaccattggtcgatggtggcgttctaaagattttgggtagaaacaaggatcaatacggcagacaacgtatgttcggttctatctcctttggcgttgcttcttccttggtcggtttcatcacagactggaccgacgatatgaacgccattttctacatctactctttttccgctatttgtttcatcttggtttgtggcaacactcaattcaagtccgaaagaatcgacgatggtcaccacagaccatacttgatccgtaccagatcctcctccactatgacatctaccttgaatactacaaacaccccaaacaatcacaagaagtctttgccatccacctctaccactacattgaacaataccacttccatctctacatcttcttccatgaacaataacaacagaagaaagatgaaacaattccaagtcgatccatacgacgaagtcggtatcgacttggattcttcccaaatcagacaaaacgaaattcaaagattgatccaattcgctaccgagtcttccatcatcgaagctgtcaacttgtccaatccaccttctcacagacgtaacgccagaccacctcgtgtcgatgaaccagctactctaatgcaattgttaaagaagccagacgtttctctattctttttgactatgatgttaatgggtgccgctttgaacatggttgtctctttcttgtttatctacttaaagcaagacttgggtgcctcttcctcccaagttggtttgactggcctaattggttcttccaccgaattggttttcttcttttactccaaggacttgatcagactattcggtatcaagtccttaatcattttgggtcacattctaaccatcatcagagtcttcgcttacaccatcattcccaagggtccaactggtgccaacattgctttgggtctacatttgttaaacggtgttgctttctctgccttgtggggtgctggcgttgtccaagccgacgaattggctccaccttccttacaagctacttctcaaggtgttttagccgctatgtacactggcatcggtgctggtttgggctctttggttggtggtgtcatttacgaacaatacggttgcaacgctatgttctacactgtcatcgctctaaccttaacttctttggaaatctacttggaaaccaacactcgttgtggtgtttccgacatgatgcgttggttgtacagaactgctatccacgtttaccaatggattcaacacgccagaggtatcggccaagctgtcccaagatggtctggtggtggtagaatcagattggaagacgatgcctag

SEQ ID NO: 184 - DNA, 1185 bp, artificial sequence
  Geobacillus stearothermophilus codon optimized coding sequence
atgggtgccgctttcaagtggggtgccgccgctagaaagaccgttttcccattgttttactttctaatcttcttcgcttttggtgccttattcccattgctatctgtctacttacaagaagaggctcgtttgtctggtgccgctatcggctggattatgtccttgccacctattgtcactatggccgctcaaccattgtggggtactgccgctgattacaccagaaagccagttggtttgttgttggccgctttggttttagccgctctattcggtgtcatgtacgccttggctggttcttacagattgttcgtcgtcctaactgttttgttatccgccatgcaatctgctatcgtcccattatccgactctttggctctacgtcatgttcacgaacaaggtggcaactacggtgctatcagattatggggttctttgggcttcgctatggctgttttggccgtcggttggttatccgaccacattgctttcgccgttatcttttacgctttctctttggctttgttaactgccgccgctttggctacccgtttaccaagataccctatgggtgctccaggtgccttgacaagacaagacgttcgtggtttgttggcttcccgtccattcagattgttgttggttgctactttcttactatttggtccaatcttggccaacaattcttacttcggtttactaatccacgaattgggtggtactttaaccggcattggtttggctttcctatttgccgctggttccgaagctccctttatgaaagccgctgacagattgattggtcgtttcggcatggtcagattgttactactagccgctttgatctctgccgctcgttggttggcttacgccgctgatccacctttgtggttcgtctacatgaccactgttgtccaaggttgttctgttggcttggccatcccaaccgctttgcaatacgccagacgtttggctccagaaagagttcaatctaccgctgtcgccttgtactctgctgttggcaacggtttgggtgcttggttctgtactttggtcggtggctacttgttggaaagatggcaaatcggtgctgtttacttgttcttttccatttgtaccatcgtcggtgttttggtcttactactattggccaagagagaaagaaccgctggtgaagaaaagtag

SEQ ID NO: 185 - DNA, 1740 bp, artificial sequence
  Neurospora crassa codon optimized CDT1 coding sequence
atgtcttctcacggttctcacgacggtgcctccaccgaaaagcacttggctacccatgacatcgctccaactcacgatgctatcaagattgtccctaagggtcacggtcaaactgctaccaagccaggtgcccaagaaaaggaagttagaaacgctgctctgttcgctgctatcaaggaatccaacattaagccatggtctaaggaatccatccacttgtacttcgctatcttcgttgctttttgttgtgcctgtgctaacggttacgacggttccttaatgactggtatcatcgctatggacaagttccaaaaccaattccacaccggtgataccggtccaaaggtctctgtcattttctccttgtacaccgttggtgctatggtcggtgctccattcgctgctatcctatctgacagattcggtagaaaaaaaggtatgttcattggtggcatctttatcattgtcggttccattatcgtagcctcttcctctaagctagctcaatttgtcgttggtagattcgtcttgggtttgggtatagccatcatgaccgttgctgctccagcttactccattgaaatcgctccaccacactggagaggtcgttgcaccggtttctacaattgtggttggttcggtggttccattccagccgcctgtatcacttacggttgttacttcatcaagtctaactggtcttggagaattccattgatcttgcaagccttcacttgtttgattgtcatgtcttctgtcttcttcttaccagaaagtcctagattcctattcgctaacggtagagatgctgaagccgttgctttcttggttaagtaccacggtaatggtgacccaaactctaagttagttctattggagactgaagaaatgagagacggtatccgtactgacggtgtcgacaaggtctggtgggactaccgtcctttgttcatgacacattcaggtagatggagaatggctcaagtcttgatgattagcatcttcggacaattctctggtaacggtttgggttacttcaacaccgtcatcttcaaaaacatcggtgttacctccacttcccaacaattggcttacaacatcttaaactccgttatctctgctattggtgccttgaccgctgtttccatgactgacagaatgccaagaagagctgttttgattattggtaccttcatgtgtgccgctgctttggctactaactctggcttgtctgctaccttggataagcaaacccaaagaggtactcaaatcaacttaaaccaaggtatgaacgaacaagacgccaaggataacgcttacttgcacgttgactctaactacgctaagggtgccttggctgcttacttcttgttcaacgtcatcttttctttcacttacacccccctacaaggtgtcataccaactgaagctttggaaaccaccatcagaggtaagggcttggccttgtctggtttcatcgttaacgccatgggtttcattaatcaattcgctggtccaatcgccttgcacaacatcggttacaagtacatcttcgtcttcgtcggttgggacttgatcgaaactgttgcttggtacttcttcggcgttgaatctcaaggtagaacattggaacaattagaatgggtttacgatcaaccaaacccagttaaggcttccttgaaggtcgaaaaggtggttgttcaagctgatggtcacgtctctgaagccatcgttgcttga

SEQ ID NO: 186 - DNA, 1578 bp, artificial sequence
  Neurospora crassa codon optimized CDT2 coding sequence
atgggtattttcaacaaaaagcccgttgcccaagctgtcgacctaaaccaaatccaagaagaagctccacaattcgagagagtcgactggaagaaggatccaggtttaagaaagttgtacttctacgccttcatcctatgtatcgcttctgccaccaccggttacgacggtatgttctttaattccgtccaaaacttcgaaacttggattaagtacttcggtgacccaagaggttccgaattgggtttgttaggtgctttgtaccaaattggttccatcggttccatcccattcgtcccattgttgaccgacaactttggtcgtaagaccccaatcattatcggttgtgttatcatgatcgttggcgctgtcttgcaagctactgccaagaacttggatactttcatgggtggtagaactatgttgggtttcggtaactctttggcccaaatcgcttctcctatgctattgactgaactagcccatccacaacacagagccagattgaccactatctacaactgtttgtggaacgtcggtgctttggtcgtctcttggttggctttcggtaccaactacattaacaatgactggtcttggagaatcccagctttgttgcaagctttcccatctattatccaattgttgggtatctggtgggtcccagaatccccaagattcttgatcgctaaggataagcacgatgaagctttacacatcctagccaagtaccacgctaacggtgaccctaaccacccaactgttcaattcgaattcagagaaattaaggaaaccattcgtttggaaatggaatccaccaagaattcttcatacttagacttcttcaagtccagaggtaacagataccgtttggctatcttgctatctttgggtttcttctctcaatggagcggtaacgctattatctctaactactcttctaagttgtacgaaaccgccggtgtaaccgactctactgctaagttgggtttgtccgctggtcaaacaggtttggctctgattgtttctgttaccatggctttgttagttgataagttgggtagaagattagctttcttggcttctactggtggcatgtgcggaactttcgtcatctggactttgactgctggcttgtacggtgaacatagattgaagggtgctgacaaggctatgatcttcttcatctgggtttttggtatcttctactccttagcttggtccggtttgttggtcggttacgccattgaaattttgccttacagattgagaggtaaaggtttgatggttatgaacatgagtgtgcaatgtgctttgaccttaaacacttacgccaacccagttgctttcgattacttcggtccagaccactcttggaagttgtacttgatttacacctgttggatcgccgctgaattcgtttttgttttcttcatgtacgttgaaaccaaaggtccaaccctagaagaattagctaaggtcatagacggtgacgaagctgacgttgctcacatcgatatccaccaagtcgaaaaggaagtcgaaatccacgaacacgaaggtaagtctgttgcctga

SEQ ID NO: 187 - DNA, 1845 bp, Saccharomyces cerevisiae
atgaagggtttgtcctccttgatcaacagaaagaaagacagaaacgattctcacttggacgaaatcgagaatggtgtcaacgctaccgagttcaattctatcgaaatggaagagcaaggcaagaaatccgacttcggtttatctcaccacgaatacggtccaggctctttgattcccaacgacaacaacgaagaggtcccagatttgttggacgaagctatgcaagatgccaaggaggccgacgaatccgaaagaggtatgccactaatgaccgctttgaagacttacccaaaagccgccgcttggtctttgttggtttccaccactctaatccaagaaggttacgacaccgctatcttgggtgccttctacgctttaccagttttccaaaagaaatacggttctttgaactccaatacaggcgactacgaaatctccgtttcttggcaaattggtttatgtttgtgttacatggctggcgaaattgtcggtttacaattgactggcccatctgtcgatttggttggcaacagatacactctaatcatggctttgttctttctagccgctttcatcttcattttgtacttttgcaagtctttgggtatgatcgctgttggccaagccttgtgtggtatgccttggggttgcttccaatgtctaaccgtttcttacgcttccgaaatctgtccattggctctacgttactacttgaccacttactccaacttgtgttggaccttcggtcaattgtttgccgctggcattatgaaaaactctcaaaacaagtacgccaattccgaattgggttacaagttaccattcgctttgcaatggatttggccattacctttggctgttggtatcttctttgctccagaatctccttggtggttggtcaagaaaggtcgtatcgaccaagccagacgttctttggaaagaaccttatctggcaaaggtccagagaaggaattgttggttactatggaattggacaaaatcaagaccactatcgagaaagaacaaaagatgtccgacgaaggtacttactgggattgtgtcaaggacggtatcaacagaagaagaactcgtatcgcttgtctatgctggattggtcaatgttcctgtggcgcttctttgattggttactccacctacttctacgaaaaggctggtgtttctaccgacacagcttttactttctctatcattcaatactgtttgggtattgccgctaccttcgtttcttggtgggcttccaagtactgtggcagattcgacttatacgctttcggtttggcctttcaagctatcatgttctttatcattggtggcttgggttgttccgacacccacggtgccaagatgggctctggtgctttgctaatggttgtcgctttcttttacaacttgggtatcgctccagtcgtcttctgtttggtttccgaaatgccatcttccagattgcgtaccaagactatcattttggccagaaacgcttacaatgtcattcaagttgttgttactgtcttaatcatgtaccaattgaactccgaaaagtggaattggggtgccaagtctggcttcttctggggtggtttttgtttggctactttggcctgggctgttgtcgatttgccagaaaccgctggcagaactttcatcgaaatcaacgagttattcagattgggtgtcccagccagaaagttcaagtctaccaaagtcgatccatttgccgccgctaaggccgccgccgctgaaatcaacgtcaaagacccaaaggaagatttggagacttctgttgttgacgaaggcagaaacacctcttctgtcgttaacaagtag

SEQ ID NO: 188 - DNA, 1182 bp, artificial sequence
  E. coli setA codon optimized coding sequence
atggccatctggattatgactatggctcgaagaatgaacggcgtctacgctgcgttcatgctggtggcctttatgatgggcgtggctggagccctgcaggcacccaccttgtccctgtttctttctcgagaggtgggagcccaacccttctggattggcctgttttacaccgtcaacgccatcgctggtattggcgtttccctgtggttggccaagcgatccgacagccagggagatcgacggaagctcatcattttctgctgtctcatggccatcggcaacgctctgctctttgccttcaatcgacactatctcacccttatcacttgtggagtgctgctcgcgagcttggccaacaccgctatgccccagctcttcgccctggctcgagagtacgcagacaactccgccagagaagtcgtcatgttctcctctgttatgcgagcccagctgtccctcgcttgggttatcggtccccctttggcattcatgcttgccctcaactacggatttaccgttatgttctcgattgccgcaggtatcttcactctcagcctggtccttattgctttcatgttgccatctgttgcccgtgtggaactgccttcggagaacgccctgtctatgcaaggcggttggcaggattcgaacgtccgaatgctttttgtggcctctaccctcatgtggacatgcaacaccatgtacatcatcgacatgcccctgtggatttcttcggagcttggactgcccgacaagctcgctggctttcttatgggtaccgctgcaggcctggagattcctgccatgatcctggctggctactatgtcaagcggtacggcaaacgacgtatgatggtcattgccgtggctgcgggtgtcctgttctacactggcctcatcttcttcaactcccgaatggcccttatgaccctccagctgttcaacgccgtgtttatcggcattgtcgctggaatcggtatgctgtggttccaggatctcatgcctggacgagccggtgctgcgactacactgtttaccaattccatttcgacaggtgttatcctcgcaggagtcattcagggtgctatcgcccagtcttggggacattttgccgtgtactgggttattgccgtcatctccgtggttgctcttttcctgaccgccaaggtgaaggacgtctaa

SEQ ID NO: 189 - DNA, 3111 bp, artificial sequence
  Acinetobacter baumanii AdeB codon optimized coding sequence
atggcctcccagttcttcattcgtcgacctgttttcgcgtgggttattgccattttcatcattattttcggactcctgtccatccctaagctgccaatcgcgcgatttccctcggtggctcccccacaggttaacatttccgctacttaccctggtgccaccgcaaagaccattaatgattctgtcgtcaccctgatcgagcgggagctctccggagtgaagaacctcctctactactccgctactaccgacacttctggtaccgcagagatcaccgccactttcaagcctggaaccgatgtcgagatggctcaggttgatgtgcagaacaagatcaaggccgtcgaggcccggttgccccaagttgtccgtcagcagggtcttcaagtcgaggcatcgtcttctggctttctcatgctggtgggcattaatagccccaacaaccagtactccgaggttgacctgagcgactacttggtgcgaaatgttgtcgaggagctcaagcgagtcgagggcgtgggaaaagtgcagtcctttggagccgagaaagccatgcgtatctgggttgaccccaacaaactcgtctcttacggtctgtctattagcgacgtcaacaacgccatccgagagaataatgtcgagattgctcccggacgactcggcgaccttcccgccgagaagggtcagctgatcaccatccccctctctgcgcagggacagctctcctctctcgagcagttcaagaacatctccctgaaatccaagactaacggctccgtgattaaactgtccgacgtcgccaacgtcgagattggctcccaggcctacaactttgccatccttgagaacggcaagcccgctaccgctgcagccatccaactgtcccctggcgccaacgccgtcaagactgctgaggtggttcgagctaagatcgaggagctgaagcttaacctcccagagggcatggagttctcgattccttacgataccgccccttttgtcaagatttctattgagaaagtgattcacacactgctggaggctatggtgctggtgttcatcgtcatgtacctgtttcttcacaatgtccgatataccctgatccctgcgattgttgctcccattgccctgcttggaactttcaccgtgatgctcctcgctggtttctccattaacgtcttgaccatgtttggaatggtccttgccatcggaattatcgtcgacgacgccatcgtggtcgtggaaaacgttgaacgaatcatggcaaccgaaggtctctcgcctaaggacgccaccagcaaggccatgaaggaaattacctctcccatcatcggaatcaccctcgttttggctgccgtctttctgcctatggcctttgcgtctggatccgtcggcgtgatttacaagcagttcaccctcaccatgtcggtcagcatcctgttctctgctcttctcgcgcttatccttactcctgccctgtgcgccactatcctgaaacccattgatggacatcaccagaaaaagggtttctttgcctggtttgaccggtcgtttgacaaggtgacaaagaagtacgagttgatgctgctcaagatcattaagcataccgtgcccatgatggtcattttcctggttatcaccggaatcactttcacaggtatgaagtactggcccacagccttcatgcccgaggaggaccagggctggttcatgacctcctttcagctcccctctgacgccaccgccgaaagaactcgaaacgtggtcaaccagtttgaaaataacctgaaggataaccccgacgttaagtctaacacaaccattctgggttggggcttctctggtgccggccagaacgtcgccgtcgccttcaccactctcaaggatttcaaggagcgaacttcctccgcttcgaagatgacctccgatgtgaactcgtctatggcgaactccaccgaaggagagactatggctgtgctcccccctgccatcgacgagcttggtaccttctccggcttctcgctgcgactgcaggacagagccaacctgggtatgcccgccttgctcgcagcccaggatgaactcatggcaatggctgctaagaacaagaagttctacatggtttggaacgagggtctgccccagggtgacaacatttctcttaagattgatcgagagaagctgtcggcttttggcgttaagttcagcgacgtctcggacattatcagcacctctatgggctccatgtacatcaacgactttccaaaccagggtcgaatgcaacaggtgatcgttcaggttgaggcaaaatcgcgaatgcaactcaaggatatcctcaacctgaaggtcatgggcagctcgggccagctggttagcctctccgaagtcgtgacacctcagtggaacaaggctccccagcagtataaccgatacaacggacgaccctctttgtccattgccggcattcccaactttgacacctcctccggtgaggccatgagagaaatggagcagctgatcgctaagctgccaaagggaattggctacgaatggaccggcatctccctgcaagagaagcaatctgagtcccagatggctttcttgctcggtctttccatgcttgtggtgtttctcgtgcttgccgcactttatgagtcctgggctatccccctgtctgtgatgctcgtcgttcccctgggaatctttggagctatcattgctattatgtctagaggcctgatgaacgacgtcttcttcaagatcggattgattaccatcatcggtctgagcgccaagaacgctatccttattgtggagtttgccaagatgctgaaggaagagggcatgtcgctcatcgaggccacagtcgctgccgcgaagcttcgactgcggcctatcctcatgacctccctggccttcacttgtggtgtgattcctttggtgattgcttctggagcttcgagcgagacacagcacgcccttggaactggcgttttcggtggcatgatctcggcaaccatcctcgctatcttctttgttcccgtgttcttcattttcattctgggtgcagttgaaaagctgttctcttctaagaagaagatctcttcgtaa

SEQ ID NO: 190 - DNA, 3114 bp, artificial sequence
  E.coli AcrD codon optimized coding sequence
atggccaacttcttcattgaccgtcccatttttgcctgggttctggctatcctgctgtgtctcactggtacccttgccattttcagcctccctgtcgagcagtaccctgacctcgctcctccaaacgtccgagtgaccgcgaattaccctggagcctctgcgcagaccctggagaacactgtgactcaggttatcgaacagaacatgaccggactcgacaacctcatgtacatgagctctcagtcctctggtactggccaggcctcggtcactctgagcttcaaggctggtaccgaccccgacgaagcagtgcagcaggtccagaaccagctgcagtctgcgatgagaaagctgccccaagctgttcagaaccagggcgtgacagtgcgaaagacaggcgataccaatatcctgactatcgcctttgtgtccactgacggctccatggataagcaggacatcgcggattacgttgcctccaacattcaggaccccctgtccagagtgaatggagtcggcgacattgatgcctacggctcgcagtactccatgagaatctggctcgaccccgctaagctgaactccttccagatgacagccaaggatgtgaccgatgcaatcgagtcgcaaaacgcccagatcgctgttggacagctgggaggtaccccttctgtcgacaagcaggcattgaacgccaccattaatgcacagtctcttctgcagacccctgagcagtttcgagatatcaccctgcgagtcaaccaggatggctcggaggttcgactcggtgacgttgccaccgtcgagatgggagcagagaagtacgactatctctcgcgatttaacggcaagccagcctcgggactgggcgtcaagctggccagcggtgccaacgagatggccaccgctgaactcgtcctgaaccgactggatgagctcgcacaatactttccccacggtcttgagtacaaggtcgcctacgagactacttccttcgtcaaggcttccattgaagatgtcgtcaagacccttctggaggctattgcccttgtcttcttggtgatgtacttgtttctccagaacttccgagctaccttgattcctaccatcgccgttcccgtggtgctgatgggcaccttttctgtcctctacgcttttggttactctgtcaacacactgacaatgtttgctatggtgcttgccatcggcctcctggtggatgacgccatcgtcgtcgtggagaacgtggagcgtatcatgtccgaggaaggcttgactccccgagaggccacccgaaaatccatgggccagattcagggagccctggtgggcattgccatggttctgtctgctgtgttcgtgcctatggctttctttggaggtaccactggcgcaatctaccgacagttttcgattaccattgtggctgccatggttctgtcggttctcgttgccatgatccttactcctgccctgtgcgcgaccctgctcaagcccctgaaaaagggtgagcatcatggacagaagggcttcttcgcctggttcaaccagatgtttaaccggaacgccgagcgttatgaaaagggtgttgcaaagattcttcaccggtccttgcggtggatcgtcatctacgtgctgcttctgggcggtatggtgttcctcttcttgagacttcccacttccttcctccctctcgaagaccgaggaatgttcacaacctctgttcagctgccctctggctccacacagcagcaaaccctcaaagttgtcgagcagatcgagaagtattatttcacacacgagaaggacaacatcatgtcggtcttcgccaccgtcggaagcggtcccggaggcaatggtcaaaatgtcgcacgtatgtttatccgactcaaggattggtctgaacgagactccaagactggtacttccttcgccattatcgagcgagctacaaaggcgttcaaccagatcaaggaggcccgagtcattgctagctctccccctgcaattagcggccttggctcgtctgccggtttcgacatggagttgcaggaccacgccggtgccggacatgatgccctgatggccgctagaaaccagctgctggctctggctgctgagaaccccgagctgaccagagttcgacacaacggactcgacgactcgcctcaactgcaaatcgacatcgatcagcgaaaagcccaggctctgggagtggctattgacgacatcaatgataccctccaaactgcctggggatcttcctacgtgaacgactttatggacagaggtcgagtgaagaaggtctacgttcaggccgcagcgccctaccggatgcttcccgacgacattaacctgtggtacgttcgaaacaaggacggtggaatggttcccttttctgcgttcgctaccagccgatgggagaccggatctccccgactcgaacgatataacggttactctgctgtggaaattgtgggtgaggccgctcccggagtctccaccggtactgccatggacatcatggagtcccttgtgaagcagctgcctaacggcttcggtttggagtggaccgcgatgagctaccaagagcgactctctggtgctcaggctcccgctttgtacgccatttcccttctcgtggtcttcctttgccttgccgctctgtacgagtcctggtcggtcccattctccgtcatgcttgtcgtccccctgggtgttattggcgctctgctggccacctggatgcgaggactcgagaacgatgtctacttccaggttggccttctgaccgttatcggcctctctgccaagaacgctattctcatcgtggagtttgctaacgagatgaaccagaaaggccacgacctttttgaggctaccctgcacgcctgtcgacagcgactccgtcctatcctcatgacctccctcgcatttatcttcggagtcttgcccatggccacctccaccggagctggttctggaggccagcatgccgtgggcaccggagtcatgggtggcatgatttcggccactattctcgccatctactttgtgcccctcttcttcgtgctcgttcggcgacgattcccactgaagccacgacccgaataa

SEQ ID NO: 191 - DNA, 747 bp, artificial sequence
  At Sweet1 codon optimized coding sequence
atggccaacatcgcccacaccattttcggtgtttttggaaacgccaccgctctgttcctttttctcgcaccctccattaccttcaagcgaatcatcaaaaacaagagcaccgagcagttctctggtattccataccctatgactctgctcaactgccttttgtccgcctggtacggcctgccctttgtgtccaaggacaatacactcgtttctaccatcaacggtactggagccgttatcgagaccgtgtacgttctcattttcctgttttacgctcccaagaaggagaaaatcaagattttcggcatcttttcgtgtgtcctggccgtgtttgcaacagttgctctggtctctctcttcgccctgcagggcaacggtcgaaagctgttctgtggcctcgctgcgaccgtgttcagcatcattatgtacgcctcgcctctctccatcatgcgactggtcgtcaagaccaagtccgtggagtttatgcccttcttcctgtctctttttgtgttcctgtgcggtacttcgtggttcgtctacggccttattggaagagatcctttcgtggctattcccaacggatttggttgtgcccttggaactctgcaactcatcttgtatttcatttactgcggcaacaagggagagaagtctgccgatgctcagaaggacgaaaagtccgtcgaaatgaaagacgacgagaagaagcagaatgtcgtcaacggcaagcaggacctccaggtgtaa

SEQ ID NO: 192 - DNA, 756 bp, artificial sequence
  At Sweet4 codon optimized coding sequence
atggttaacgctaccgtggcaagaaacatcgctggtatttgcggcaacgttatctccctgttcctttttctctcgcccattcctacattcatcaccatttacaagaagaagaaagtggaggagtacaaggcggacccatatctggccaccgtgctcaactgtgccctgtgggtgttttacggcctgcctatggttcagcccgattctctgctcgtcattacaatcaacggcactggtttggcaatcgagcttgtttacctggctatcttctttttcttttctcccacttcgcgaaaggtcaaggttggcctgtggcttattggagagatggttttcgtcggtatcgtggccacttgcaccctgctcttgttccatacccacaaccagcgatcctctttcgtgggaatcttttgtgtcattttcgtgtcgctcatgtacatcgctcccctcaccattatgtccaaagtcatcaagaccaagtccgtcaaatacatgcctttcagcctgtcccttgccaatttcctcaacggtgtggtttgggtcatttacgccctcatcaagttcgatctgtttatcctcattggcaacggactgggtaccgtcagcggagctgtgcagctcattctgtatgcctgctactacaagaccactcccaaggacgacgaagacgaggaggacgaggaaaacttgtccaaggtcaattctcaactgcagctttcgggaaactctggccaggccaagcgagtctccgcctaa

SEQ ID NO: 193 - DNA, 870 bp, artificial sequence
  At Sweet10 codon optimized coding sequence
atggccatttctcaggctgtcctggccaccgttttcggcattctgggaaacatcatttccttctttgtgtgcctggctcccattcctactttcgtgcgaatctacaagagaaaatcttcggagggttatcagagcattccctacgtcatctcccttttcagcgctatgctgtggatgtactatgccatgatcaagaaggacgctatgatgctcattaccatcaactccttcgcctttgtcgttcagatcgtgtacatttctcttttcttcttctacgcacccaagaaagagaagacccttactgtcaaattcgttttgtttgtcgatgtgctgggctttggtgccattttcgttctcacctactttatcattcacgcgaacaagcgggtccaggtgctcggctacatttgtatggtgtttgccctctccgtcttcgttgctcctcttggaatcattcgaaaggtcatcaaaacaaagtctgccgagttcatgccctttggtctgtcgttcttcctcaccctgtctgccgttatgtggttcttttacggtctgctgctcaaggacatgaatatcgctctgcccaacgtcttgggcttcatctttggtgtgcttcagatgatcttgtttctcatttacaagaaacctggcaccaaggttctggagcctccaggaatcaagctgcaagacatttccgagcatgtggtggatgtcgttcgactgtctactatggtctgcaactcgcagatgcgaacactcgtcccccaggattccgcagacatggaggccaccatcgacatcgacgaaaagatcaaaggagatatcgaaaagaacaaagacgagaaggaggtgttcctcatctccaagaactaa

SEQ ID NO: 194 - DNA, 873 bp, artificial sequence
  At Sweet11 codon optimized coding sequence
atggcctcgctgttcaacaccgagaacacttgggccttcgtctttggcctgcttggaaacctcatctcgttcgccgtttttctgtctcccgtgcctaccttctacagaatttggaagaagaaaaccacagaaggtttccagtccattccttacgtcgtggccctgttctctgctaccctctggctgtactatgccacccagaagaaggacgtgttcctgctcgtcaccatcaacgccttcggatgctttatcgagacaatctacatttcgatgtttctggcatacgctcccaagcctgcccgaatgctcaccgtcaagatgctgctccttatgaactttggcggtttctgcgctattctccttttgtgtcagtttctggtcaagggtgctactcgagccaagatcattggtggaatttgtgtgggcttttccgtctgtgtgttcgctgcacccctgtccatcattcgaaccgttatcaagactcgaagcgtggagtacatgcctttctcgttgtcccttaccctcactatttccgctgtcatctggctgctttacggcttggccctcaaggacatttacgttgccttccccaatgtgcttggttttgcgctgggagccctccagatgatcctgtacgtggtttacaagtattgcaaaacctctccccacctgggagagaaggaggtcgaagctgcaaagctccccgaggtttctctggatatgctcaagttgggtactgtttcctctccagagcccatcagcgtcgtgcggcaggccaacaagtgtacctgcggcaacgaccgacgtgcggagatcgaagatggccaaacacccaaacatggaaagcagtccagctctgccgctgccacctaa

SEQ ID NO: 195 - DNA, 672 bp, artificial sequence
  Batrachochytrium dendrobatidis codon optimized coding sequence
atggccaccctgctcgagtggtgcgccatcctgcttaccgtcggcatgtttctcaccaatttcaacacactgcgactctacatgcggaccggcactacaggtcacgctaccactattcccttcgtttgcacactgctcaactgttccttgtggttccgatacggactgctcgtgcagcttacctctctggttattgtcaacgctgtgggcatcctggtctccattgtttcgctgtatgtcttctgcaagtacaccgaccgacaaagcgatgcccagatccccatcattactgccttgggattcctctacctggtgtttgtttatgtccatctggtgtctggctcggcaatgctcaaacagtacggctttcttaccgcgactttctctatctttatgtacggtgctcctctgttgtccctcgccaacgtcattcagctcaagtctgctactggtcttatctcgctgcctatgacctgtatcagcctcattgtgtgctgtctgtggaccgccttcggttaccagatccaagacaacttcgtcctcatcccaaacaccattggtggaatcttgtgtctgttccagcttattgtgctgcgtatctaccccgacgagaagaacggatacaccattcaccagccttcccttcccatgtctgaccgaagatcctactaa

SEQ ID NO: 196 - DNA, 705 bp, artificial sequence
  Batrachochytrium dendrobatidis codon optimized coding sequence
atggcctccaccatcgagtgctctactcccaactgtcagctggtcctccaccatatcattcctatcattggcgtgttcacagccctgtggattttcatcgctcctttcaagtccgtcaagcgactcggcaacagcgacaatttggagaacgtcaaccccctgccattccctatgattgtggcaaactgcctgggttggcttgtgtacggcctgctcattcaggatatctacgtcatcattcccaacatcattggatatcagtttggcatctactatactctcatggcctaccgaatcgctgcacccgagtttcaatccagagccttgcagattctcatcggttcctcgctgttggttttcattggtggagtgcttggcttcatcgttctccagggaaacgaagccggtcggattgtcatgggactggtgtgtgtcgttattctggcggtgttctactgctctcctctgtccgacttttacaatgttatcaagaagaaagatgcttcctctatcgacgtgtaccttgccgctgcgagcctcgtcaacggttctctgtggaccgtgtacggttttgccattggcgacaccttcatctggtctcccaacctccttggagtcgttctgtcgcttgtgcagtttgttctgctcgccatctttgctcgacccaagtcgcacgagttccaggtcctgcgaaacgccacctaa

SEQ ID NO: 197 - DNA, 714 bp, artificial sequence
  Batrachochytrium dendrobatidis codon optimized coding sequence
atggcctctgctatcgtgatgaaccacgtcctccctgctctgggcgttgcattcgccatttccatctacctgtctcccttcacccacgtgtggaagtcgctcaaaaacaaggaagcctcgctggtcaacaccatgccctacccttggatcattgccaattgccttggatggattgtgtacggttgtcacactggcgactactatgtcttcgtggccaacattgtcggctaccatctgggtcttttctacaccctctcctctctgcactacggaagcgacaagtttcgaaccactgctgcggtcatcgttcttggctccagcttcctggtgctcacttctgcgttcgtggtttttgctattctccggcaggcccaaccctccaagaccgtcctgggatcggtttgcgtgtttatcctcgtcattttctatgcctctcccctgtcggatctcgcatccgttatcagatcgcgagacgcctcctctatcaaccccattttgggtttctgttctctgctcaacggagccctttggacaggctacggttttgccatcagcgatcctttcatttgggctccaaacgtcgtgggtgtggttctgtccatcgtccagctcttcctgtgctttttgtttcgaggaaacaagtccaccgtcaattctcagggcacacttcccacctccaaggctctggaggccgagtaccaccattccacctaa

SEQ ID NO: 198 - DNA, 702 bp, artificial sequence
  Rozella allomycis codon optimized coding sequence
atggccgacttcctgcttggccagatcgtcccagcactgggagcctgcatttccatcttcctgtttctctctcccatgaaggccttcatggtgcacagcaccaagtacgacttcaaccctcttgccgctatcaccatgattctcaactgtctgtcctggatcttttacggcattttcgtcaaggacatctacatcattactcccaatgttcctggtcttacactgtccgtgtggtacaccgtcaacgtgtatcaccacggagttgccaacaatcctcagagaaagtactacgacgccattctggtcctcggtatctttcttattctgctcgtggattccgcgatcgctccccagctgttggatgtcgctgcagcgcaaactatggctggctatatgtgcatcattatgctgctcttcttttacatttctcccttgtccacccttgcaaactgtgtcaaagagaagtctgctgtttcgatccatttcggtctctctgttgcctcgctggtcaacggactcctttggaccgtttacggaattgctatccaggacgcctttgtgtacggtcccaacttcgtgggctgcctgtccgcctcggtgcagctgctgctcaagttcatctaccgaaaaagcgacaaggccctgttgcccctccgaaacatcgaaaaggactcgctcgattctgccgagattgcttcctaa

SEQ ID NO: 199 - DNA, 696 bp, artificial sequence
  Albugo Candida codon optimized coding sequence
atggagaacgtcttcctggtgtccaccctccttatgacaaagtctatccccgttattgccgcaggctcctctctcatcttcgctatttcccccatgaccactacacgatccatccagagagccaagagcaccctgcagtacccctttgctcctttctttttcttctttatccagaacgtcattaccctgctctacgcttacgccacttggaaccacatcattgcacttactgccgctctgtcctcttcgttgggtgcgtactatgtctatatctactacaagcactccaaacagaagacccatccacgacgtatgctgggtatcgcttgttttggcattctgctcttggctgtcaatgccctgcctcgagagcccgaagacgcgcagtggatcattggagtgcccagccttatcctgtccattctcacctcttcgagccctctcatgcaaattcgagacatcctcaaacggaaggatgcctcttgcctgcccttcggtatgtccgttatgaacctcatttctggatcggtctggaccctgtacggctcgattctcaaggaccctcttatcattgtgcccaacatcatcgccctgtctatgggaattgtgcaggtttcccttatcttcctgtacccctcgaagtccacccgaaaggccaactgggagtctgacggtggcatcgagcgagccgattaa

SEQ ID NO: 200 - DNA, 717 bp, artificial sequence
  Albugo Candida codon optimized coding sequence
atggcctccacctggcagtcgatggagaacgtcttcctggtgtccactctccttatgacaaagtccatccccgttattgccgctggctcctcgcttatcttcgccatttcccccatgaccaccactcgatccatccagcgtgcaaagagcactctgcagtacccctttgctccattcttctttttctttatccaaaacgtcattacactgttgtacgcttacgccacctggaaccatatcattgcgctcactgccgctctgtcctcgagcctcggtgcttactatgtgtatatctactacaagcactccaagcagaaaacccaccctcgacggatgctgggaattgcctgctttggcatcctgctcttggcagtcaatgcgctgcctcgagagcccgaagacgcccagtggatcattggtgttcccagcctcattctgtcgatccttacctcctcttcgcctctcatgcagatcagagacattctcaaacgaaaggacgcctcttgtctgcccttcggaatgtctgttatgaaccttatctctggaagcgtgtggaccctgtacggttctatcctcaaggatcctcttatcattgtccccaacatcattgctctgtctatgggcattgtccaggtgtctctcattttcctgtacccctccaagtctacccgaaaggccaactgggagtctgatggcggtatcgagcgagccgactaa

SEQ ID NO: 201 - DNA, 678 bp, artificial sequence
  Albugo Candida codon optimized coding sequence
atggcctccagcctctacctgttcgcttccccttttgccgacatccgagctattcaggcagcgaagatcaaacactctcgacggatcctgcccctcacctctatgttctgcaacgccatttgttggtgcctgtacggcattctcgcccacaacatcttccccctgctccttaccaacgccgtcggcatcatcatcgttacttactacctgtatatcttctccaagtacgcctcggattccgttcatgtcagaaagtgtctcattggtatggctgtcaccctgtccatcttcttcagcttttgcctttttgctcccgtgtcccatgccactgttcagtccgtcgtgggatataccggcatttctgtgtgtacagttatgtttgcctcccccttggctgtcgtcaagaaagttattgccgagaagtcgagcgatatgctgcccttccctatgatcgtcgctgcgtttatgaactctattctgtggctcgtgtacggtcttatgattcacgacatcattgtgttcctgccaaatctcatcaacttctttttggctggtatgcaactgtctctcttcgtcatttaccctcgaaccaagggatacgtgtccatgcactcttcggtggccatcatggacgcaaagattttcgtgcccgtctcttcggaccttgagaaggcctaa

SEQ ID NO: 202 - DNA, 543 bp, artificial sequence
  Albugo Candida codon optimized coding sequence
atggcctccgtcctcgccttctgcatgtgtctgtcccccatcccagacatgattcacatccagaaggagcgatctaccgacagcctccctctgttgtcccttgtcgccctgtggatcaactgccatgtgtgtgctatgtcgattgtgtacctggttatctatcagaaatacgcctactgtcacaccagagtgctgctttccaacttgtgcgccttcatcctcaacatttgtcttaccatctttgcttgcacaggttcttcgattgtcagccaagaaactctggtcaagtgtttcggatacattgccaacgtttctggtctgctcttgtacggctctcccctcatcaacgtcgtggaggccgttcaggcaaagaacgctacttccatccccattgccatgaccgtcgtgggcctggcgaacaatgctacctggattctgtacggattcctcatcgacgatatctacctcattgcaccttgcgtcatcaacactatggtttgtctcattcagctgtttgtttgcgctgtgctgcagcttacctaa

SEQ ID NO: 203 - DNA, 1203 bp, artificial sequence
  Bacillus subtilis codon optimized coding sequence
atggcccacaacctgcaggtccgaagacactacgctgcactcaagggcttctacctgttcgcctttctcggaaccggctccatcattcccctgctctctatgtaccttaccaaggagcagcatctgtctggatcccaggtgggcctcatcatgtcgttgggtcctattgttatgatcttctttcagcccttctggggaatgctgtccgactacactcaaaagaccaaaggactgcttgccgtgtgcacttcgattaccggcatcatcggtctggcttacattgccttcgattcctttcctttgttcattcttatcgctgcgtgcttcgctgcatttcagtccaccatcatccccctcagcgattctatttccctgcgatacactcaggaaacaaatggcaactacggtggtattcgactcttcggcagcctgggttttggagtcgccgtgttcgctatgggccaagttaccaaccagctttaccccatccacgtcattttcatctttggctgtgctttcctgtgcattgccgctatcttggcgtctcaagtccctggccagcagaagactacaaaagtcaacattcggaagggattccgagagctcatttccaacaagaccttcctcatctttatgatcattaccttcactacatttgctccaaacctggccaacaatacctatttctctctctttctggacaagagcggtgcctctctctcggctatcggtattctgttctttatcggcgttatctccgagattccctttatgcgtttcgcccagacctttatcgacaagatgggtctgctcaacgtcatcatgctgtctggtggagtctcgctgttccgatgggccttgtactttactgctccctctctgtggatcatttacgccaccgtttttctgcagggagtggccattggtctcttcatccctgctgcactgcagtacgtcaagaagattacaccccgacacgtggaggccactgctcttaccatgtacgcagcgatcggaaacggttttggcaactggttctgtacctttgccggtggatacattttcgactatgtgtccatcttcgccgtttatctgcttttcggcatcctctcgattgccggattcggccttaccctctaccttatgaaagccgagaagaacaagcacaccctccatcagcctgccgtgaccttcaagccctag

SEQ ID NO: 204 - DNA, 1182 bp, artificial sequence
  Bacillus subtilis codon optimized coding sequence
atggcctggctggcaaactttttcgtctcggcctctaccactatgatcgtgcctttcctcagcctgtacatcgagaccctctcctctttctcgaacggctttgtgcagcgatggtccggctacgtgtttggtatcaccttcctcatggcttttctggtgtccccattctggggtcgatttggagacaaaagaggctacaagaagattctcatggccacaggtaccggcattgccctgtctatcttctttatgggatttgtcacctcggtttaccagctgttctttctccgaatggcgatgggactggtcaccggcttcatccccacatcgctggccatgatctccgctcagacccccaagtcctctgccggaaagaccctgggtactctccaaatgggccaggtcagcggttctctcttcggacccctgcttggcggtatgctcgccgacagattcggttttacttacacctttttcattacttcctttgttatcttctcgagcgtcctccttgtgctgttcggcgtcaaggaaaagcatctggccgagaaaactgcaaagcgtacctcctattctcgaaaggaggtgctgtcctacattttccaccatcctgccctctgggttatgatgctgcttaccatgctcatccagactggcaacttctctatccagcccctccttgccttgtatgtcaacgagcttcacggtcctgtcaacctggccttcttttccggcatggccttcagcgctaccggcttgggttccctgctccttgcacgaaagtggggagatttgggcgatcgttacggacaccgacggattcttatcggtctgctcttggctgcgtccttcttcttcattccccaggctctggcctcctctctctcggttctgcttgtgtttcggttcctgtttggcatggctatgggtggactgctcccctgtattaccgctgcgatccgagtccaggctcccggttcgattcagggcgaggttctgggatacaatgtgtcttttcgattcctgggaaacgtgcttggccctctgctcggtggaatcatttcctctcacttcactatcagcgccaccttctacgttacagcatttcttttcttcgctggagcctgcatgttgtggattatgcaaaagttgcgaaaggactcctacgctaaggcctcttaa

SEQ ID NO: 205 - DNA, 1689 bp, artificial sequence
  Mucor circinelloides codon optimized coding sequence
atggccccctaccttgctcctaagctgctgtacacctttttgttcgcctgccagggctccgcacccgtctatctggctttgttctactcttcgcagctgggtctcaagggcgaccagatcggtctgcttgtcgccattgcacccttcatctccgctattgcctgtcccctgtgggctgcgattgccgacaagaccaaaacacactcttacatcatgtgcattgtccacaccctggctactatcgccattgtctcggttatgggcatctctgtcgtcgttcagccaatcgtggacgaggtcgatcgaaacaagctcaccatcgccctggtcacagttacctctgtgtgtttcgccttctttggcgtccccgttctgcctttggtggacggtggagttctcaagattcttggacgaaacaaggaccaatacggaagacagcgaatgttcggctccatttcttttggagtggcctccagcctggtcggcttcattacagattggaccgacgacatgaacgctatcttctacatttactctttttccgcgatttgtttcatcctggtgtgcggcaacacccagttcaagagcgagcgaatcgacgatggccaccatcgtccttacctcatccgaacaagatcctcttcgaccatgacttccacactcaacaccaccaatacacccaacaaccacaagaaaagccttccctccacatcgaccactactctcaacaataccacaagcatttctacttcctcgagcatgaacaacaacaatcgacggaagatgaagcaattccaggtggatccctacgacgaggtgggcatcgacctggattcctctcaaatccgacagaacgagattcaacgactcatccagttcgctaccgagtcctctatcatcgaagccgtcaacctcagcaatcccccttcccaccgacggaacgccagaccccctcgtgtggacgaacccgctacccttatgcagctgctcaagaaacccgatgtgtccctgttctttctcaccatgatgcttatgggtgccgctctcaacatggtcgtgtctttcctgtttatctacctcaagcaggatctgggtgcctcctcgagccaggttggcctcactggtcttatcggctcctctaccgagctcgtcttcttcttttactccaaggaccttattcgactgtttggaatcaagtccctcatcattctgggccatatcctcaccatcattcgagtcttcgcctacactatcattcccaagggtcctactggagccaacattgcgttgggacttcatctgctcaacggcgtggcattttctgccctgtggggtgctggcgtggttcaggccgacgagttggctcctccatctctgcaggccacctcccaaggtgtgctggctgcaatgtacactggtatcggagcaggccttggttcgctggtgggaggagttatctacgagcagtatggttgcaacgctatgttttacactgttattgccctcacccttacttcgttggagatttacctggaaaccaacactcgatgtggagtctcggacatgatgcgatggctgtatcggaccgccattcacgtctaccagtggattcaacacgctcgaggtattggacaggccgttcctcgatggtctggtggaggccgaatcagactcgaggacgatgcctaa

SEQ ID NO: 206 - DNA, 1185 bp, artificial sequence
  Geobacillus stearothermophilus codon optimized coding sequence
atgggagctgccttcaagtggggtgccgcagcgcgaaaaaccgtctttcccctgttttacttcctcatcttctttgcctttggcgctttgttccccctgctttccgtttatctccaggaggaagctcgactgtctggagccgctattggttggatcatgtcgctgcctccaattgtcacaatggctgcacagcccctgtggggcacagctgcggactatacccgaaagcccgtgggcctccttttggcagcgctggtgcttgctgcactcttcggagtcatgtatgccctggctggatcctaccgactgttcgtcgttctcactgtgctgttgtctgctatgcagagcgccatcgtccccctgtcggattctctcgccctgcggcatgtgcacgagcagggaggaaactacggtgccatccgactgtggggttccctcggcttcgctatggccgttctggcagtcggttggctttccgaccacattgcgttcgccgttatcttttacgctttctcgctggccctccttaccgctgcagcgctcgccactcgactgcctcggtacccaatgggtgctcccggagccctcacccgacaggacgtcagaggcctgctcgcctcccgtccttttcgactgctgctcgtggccaccttcctgctttttggccctattctggccaacaattcctacttcggtctgcttatccacgagctcggtggaacacttaccggcattggactggcattcctctttgccgctggctccgaggcaccctttatgaaggctgcagaccgactcatcggacggttcggcatggtgcgactgctccttcttgccgcactcatctctgctgcgcgatggttggcctacgctgcagatccccctctgtggttcgtgtacatgaccactgtcgtgcagggctgctcggttggtttggccattcctaccgctttgcaatacgccagacgtcttgctcccgagcgagtccaatctactgctgttgccctgtacagcgctgtgggcaacggtctgggagcctggttctgtaccctcgttggtggatacctgctcgagcgatggcagattggtgccgtctacctcttcttttctatctgcactattgtcggcgtgctcgttctgctgcttttggccaagagagagcgaaccgctggcgaggaaaagtaa

SEQ ID NO: 207 - DNA, 1743 bp, artificial sequence
  Neurospora crassa codon optimized CDT1 coding sequence
atggcctcctctcacggctcccatgatggtgcctctactgagaaacacctggccacccacgacattgcccctacccatgacgctatcaagatcgtgcccaagggtcatggacaaaccgcgactaagccaggagctcaggagaaagaggttcgaaacgctgcgttgttcgcagcaatcaaggagtccaacatcaagccctggtcgaaggagtccattcacctgtacttcgccatcttcgttgccttttgttgtgcttgcgccaacggctacgatggttccctcatgacaggaatcattgctatggataagtttcagaaccagttccacaccggagacacaggtcccaaagtgtctgtcatcttttctctgtacacagtcggagcaatggtcggtgccccattcgccgctatcttgtctgaccggtttggacgaaagaagggaatgttcattggcggtatcttcattattgttggttcgattattgttgcctcttcctctaagctcgctcagttcgtcgtcggccgttttgtgctgggtctgggcattgctatcatgaccgtggcggctcctgcctactccatcgagattgcccctcctcactggcgaggacggtgcactggcttttacaactgtggctggtttggaggctctattcccgctgcctgcatcacctacggatgctactttatcaagtctaactggagctggcgaatccctctgatccttcaggccttcacctgcctgattgtcatgtctagcgttttctttctgcccgagagccctcgattccttttcgcgaacggtcgagacgctgaagccgttgcattcctcgttaagtaccatggcaacggtgatcccaactctaagctcgtcctgctggagaccgaggaaatgagagacggaatccgaaccgatggagtcgacaaggtgtggtgggattatagaccccttttcatgactcactccggtcgatggcgtatggcgcaggtgcttatgatctccatcttcggccagttctccggtaacggtcttggatactttaacactgtcatcttcaagaacattggagtcacctccacctcgcagcagctcgcctataacattctcaacagcgtgatttcggctatcggcgcactcacagctgtttccatgactgaccgaatgccccgacgagccgtcttgatcattggaaccttcatgtgtgcagctgccctcgctaccaattcgggactgtcggccaccctcgacaaacagacccaacgaggtacccagattaacctcaaccagggtatgaatgagcaggacgccaaggataacgcttacctccatgttgactccaattacgccaagggagccctggccgcttacttcctgttcaacgtgatcttttcttttacttacactccccttcagggcgtgattcccaccgaagcccttgaaaccactatcagaggcaagggcctggctctgtcgggtttcattgtgaacgcaatgggctttatcaaccaattcgccggtcctattgccctgcacaacattggctacaagtatatcttcgtgtttgtcggctgggacctcatcgagaccgtggcttggtactttttcggtgttgagtcccaaggccgaacactggaacagctcgagtgggtctacgaccagcccaatcccgttaaggccagcttgaaggtcgagaaggtggtcgtgcaggccgacggccacgtctcggaggccattgtggcctaa

SEQ ID NO: 208 - DNA, 1578 bp, artificial sequence
  Neurospora crassa codon optimized CDT2 coding sequence
atgggcattttcaacaagaaacccgtcgctcaggccgtcgatctcaatcagattcaggaggaggctcctcaattcgaacgagttgactggaagaaagatcccggacttcgaaagctctacttttatgcgttcatcctgtgtattgcctctgcaaccaccggatacgacggtatgttctttaactccgttcagaactttgagacctggattaagtactttggtgacccccgaggctctgaattgggtctcctcggtgctttgtaccagatcggcagcattggatcgatccccttcgtcccactcttgacagacaacttcggccggaaaacccctattatcatcggatgtgtcattatgatcgtgggagctgtgctgcaggctaccgccaagaacctggacactttcatgggtggacgaactatgctgggttttggtaactcgctggctcagattgcctcccccatgctcctgaccgagctggcacaccctcagcatcgtgcccgactgaccaccatctacaactgcctgtggaacgtgggagccctcgtggtctcctggcttgccttcggcaccaactatattaacaatgattggtcctggcgaatccccgctctcctgcaggccttcccctctatcatccagctcctgggaatctggtgggttcccgagtcccctcgatttctgatcgccaaggataagcatgacgaggctctgcacatccttgccaagtaccacgccaacggcgaccctaaccaccccacagtgcaattcgagtttagagagatcaaggagactattcgactcgagatggagtccactaagaactcgtcgtacctggactttttcaagtctcgaggcaaccggtacagactcgccattctcctgtcccttggcttcttttcgcagtggtctggtaacgccatcatttccaactactcctctaagctctacgaaacagcaggtgtgaccgacagcactgccaaactgggactctctgcaggtcaaactggtcttgccctcattgtttctgtcacaatggcactgctcgttgacaagttgggccgacgtcttgccttccttgccagcaccggaggcatgtgcggtaccttcgtgatttggactctgaccgcgggtctgtacggtgagcaccgactgaagggagcggacaaggctatgatcttcttcatctgggttttcggaatcttttattccctcgcttggtcgggccttctggtcggctacgctattgagattcttccctacagactgcgaggcaagggcttgatggttatgaacatgagcgtccagtgtgctcttaccctgaacacctacgcgaatcccgtggctttcgattactttggcccagaccactcctggaagctctacctgatctatacctgctggatcgctgccgagttcgtctttgtgtttttcatgtacgtcgagaccaagggacctactttggaggagcttgccaaggttatcgacggcgacgaagccgatgtcgcccacattgatattcatcaggtcgagaaggaagtggagatccatgaacacgagggaaagtctgtggcctaa

SEQ ID NO: 209 - DNA, 1848 bp, artificial sequence
  Mal21 codon optimized sequence
atggccaagggcctgtcgagcctcatcaacagaaagaaagaccgaaacgattctcatctggacgagatcgaaaatggcgtcaacgccaccgagttcaattctatcgaaatggaggagcagggaaagaaaagcgacttcggcctttcccaccacgagtacggtccaggatcgctcattcccaacgacaacaacgaggaagtccccgatctgctcgacgaggccatgcaggatgcgaaggaagccgacgagtccgagcgaggaatgccccttatgactgccctcaagacctaccccaaagccgcagcgtggtccctgcttgtgtctaccactctcattcaagagggatacgataccgccatcctgggtgcgttctacgccctgcctgttttccagaagaaatacggttctctcaactccaatactggcgactacgagatttcggtctcttggcaaattggcctttgcctgtgttacatggctggcgagattgtcggtctgcagctcactggaccctctgtggacctggttggcaaccgatacaccctcattatggccctgttctttctcgctgcattcattttcatcctctacttttgcaagtccctgggtatgatcgccgttggccaggctctgtgcggaatgccctggggctgcttccagtgtcttactgtttcttacgcctccgagatttgtcccctcgccctgcgatactatctcaccacatacagcaacctctgttggacattcggccagctgtttgccgctggcattatgaaaaactcccagaacaagtatgccaattcggagttgggatacaagctgcctttcgctcttcagtggatctggcctcttcccctggccgtgggaatcttctttgctcccgagagcccttggtggctggtcaagaaaggtcggatcgaccaggctcgacggtccttggagagaaccctgtctggcaaaggtccagagaaggaattgttggttactatggagctggacaagatcaaaaccactatcgagaaggaacagaaaatgtccgacgagggtacctattgggactgcgtcaaggatggaatcaaccgacggcgtaccagaattgcttgtctttgctggattggacagtgttcctgcggtgcctctcttatcggatattcgacctacttttacgagaaggctggtgtttcgaccgacacagcttttactttctctatcattcagtactgcctcggcattgccgctacctttgtcagctggtgggcctccaagtactgtggacgattcgacctctacgcattcggcctggcgtttcaagctatcatgttctttatcattggcggtctgggatgctccgatacccacggtgccaagatgggctcgggagccctccttatggtcgtggccttcttttacaacctgggtattgcccctgtcgtgttttgtctcgtttccgagatgccctcttcgcgtcttcgaacaaagaccatcattctggctcgaaatgcctacaacgttatccaggtcgtggttaccgtgctcattatgtaccagctcaacagcgagaagtggaattggggagccaagtctggcttcttttggggtggattctgcttggccaccctggcatgggctgtcgtggatctgcccgagactgctggtcgaaccttcatcgagatcaacgaactgttccgactcggcgtgcctgcccgaaagttcaaatccacaaaggtggacccttttgccgcagcgaaggctgctgctgcagaaatcaacgtcaaggaccccaaagaggatttggaaacctccgtcgtggacgagggtcgaaacacctcttccgtcgtgaacaagtaa

SEQ ID NO: 210 - DNA, 1131 bp, artificial sequence
  expression cassette for E. coli GMD
aattaattatccatggcctcctctcccatcgaggtggtcaacatgtcccctgccgactaccgaaacagaaaggtcgctctcattaccggcatcactggtcaggacggatcctacctggcagaacttctcatcgagaagggttaccaagttcacggcatcattcgaagatcttcctcgttcaacaccggacgaatcgagcacctgtacaaggatgctcacgagaaccccaagatgcgacttcatcacggagatctcaccgacagcacatgcttggtgcacatcatttccaaagttctgcccaccgagatctacaacctcggtgcccagtctcacgtcaaggtttcctttgacatgtcggagtacactgcagacgtggatgccgttggaacccttcgactgttggacgccattcggacttgtggcctgagccaccttgtgcgattctaccaggcttctacctccgagctctacggcaaggttgccgaaatccctcagtccgagaccacacccttttacccacgttctccctacggagtcgccaagatgtatgcgtactggattaccatcaactatcgagaggcttacgacatgtatgcctgcaacggcattctcttcaatcacgagtctcccagacgtggtcgaacgtttgtcacccgaaagatcacttgtgccgttgcttccattcacctgggcaagcaggagtgtctttacctcggcaacctggacgccaagcgagattggggtcatgctcgggactacgtcgagggaatgtggcgtatgctccagcaagagacagccgaagactttgtgctggctaccggcgagatgcatactgttcgagagttcgtcgaaaagtccttcaaagccatcggttcgaccattcgatgggagggcagcgcagaggaagaggttggactggacgagaagggtgtcattcgggtgagagtcgatcccgcttactatcgaccgaccgaagtggagctgctccttggcaatcctgccaaggcgaacgagaaactcggctggaagcgacaggtcgagttcgatgcccttgtggaagagatggtcaagtccgatctcatcggtgttgctgccggagacgtcttcaactaagcggccgcttaattaata

SEQ ID NO: 211 - DNA, 1000 bp, artificial sequence
  expression cassette for E. coli GMER
atcaattatccatggcctccccctcgaagtctgtcatcatggttaccggaggctccggtctggtcggcaaggccatcgactgggtggtcgagaacgactcgaagtacggcaagcgagagggagaagagtgggtgttccttacctccaaggatggcaacctcatcgaccctgctcagaccaaggccattttcgagaagtaccgacccacccacgtcattcatctggctgccaaggtgggtggactctttggcaacatggctgcaaatctggattacttccgagacaacctccttatcaacgacaatgttctgcacaacgccaaggagtttggtgtcaagaaagtggtttcctgtctctctacttgcattttccccgacaagaccagctacccaatcgacgagacaatggtccaccagggacctccccacgattccaactacggctattctcattccaagcggatggtcgacgttatgaaccgagcctacaatcagcaatatggatgcaacttcacttcggtcattcccaccaacgtgttcggtccacatgacaactttcacctggtcaactcccatgttattcctggcctcatccacaagtgttacctcgctcaacagaacaatactcccttcatcatggcaggcaccggacgacccttgcggcagttcatctactctcgagacctggcccgtctcttcatttggaccctgcgagagtaccaggagatcactcctctcattctttccgtgcccgaggaagaggaagtctctatcaagcaggttggcgattcgattgtcaaggcgatgggatacacaggcgactaccgatttgatactaccaaggccgacggtcagtacaagaaaaccgcttccaacaagaaacttatgtctctcaaccccgactttcagttcactcctttcgatgttgccctgtccgagaccgtcgaatggttcaaggagaacgtggacaccatccgaaagtaagcggccgcttaattagt

SEQ ID NO: 212 - DNA, 1794 bp, artificial sequence
  expression cassette for LAC12
aattaattatccatggccgaccactcctcttcgtccagctctctgcagaagaaacccatcaacaccatcgagcacaaggacactcttggcaacgatcgagaccacaaggaggctctcaactccgataacgacaatacctcgggactcaagatcaacggtgtccccatcgaggacgcccgagaagaggtgctgcttcctggctacctctccaagcagtactataagctgtacggtctctgcttcattacctacctttgtgccactatgcaaggctacgatggagctctcatgggctccatctacaccgaggacgcctacctcaagtactatcatctggacatcaactcttcgagcggtactggacttgtcttttccatcttcaacgtgggtcagatttgcggagcgttctttgttccactcatggactggaagggtcggaaacctgccattctcatcggctgtcttggagtggtcatcggtgccatcatttcctctctcaccactaccaagtccgctcttattggcggtcgatggttcgtcgcctttttcgcaacaattgccaacgctgccgcacccacctactgtgccgaggtcgctcctgcacatctgcgaggcaaggtggctggactctataacaccttgtggtcggtcggctcgatcgtggctgccttttccacatacggtaccaacaagaatttccccaactccagcaaggccttcaagattccactgtacctccagatgatgtttcccggactggtctgcatcttcggctggctcatccccgaatctcctcgatggctggttggcgtcggacgagaggaagaggccagagagttcattatcaagtaccacctcaacggcgatcggacccatcctctgctcgacatggagatggccgaaattatcgagtccttccacggaaccgatctgtcgaatcccctcgagatgctggacgtgcgatccctcttccggactcgaagcgacagataccgagccatgctggtcattctcatggcatggttcggtcagttttctggcaacaatgtctgctcctactatctgcctaccatgcttcgaaacgtcggtatgaagtcggtgtccctcaacgttcttatgaacggagtctactctatcgttacttggatttctagcatctgcggtgccttctttatcgacaagattggacgaagagagggcttccttggatccatcagcggtgccgcactggctctcactggcttgtcgatctgtacagcccgatacgagaagaccaagaaaaagtccgcttccaacggagccctcgtgttcatctacctgtttggtggaatcttctcgtttgccttcactcccatgcagtccatgtactctaccgaggtctccacaaatctcacccgaagcaaggctcagctgcttaactttgtcgtttcgggagtcgcccagttcgtcaaccagtttgcgactcccaaggccatgaaaaacatcaagtactggttctacgtgttttacgttttctttgacatcttcgagtttatcgtcatttacttctttttcgtggagaccaaaggcagatccctggaggaattggaggttgtcttcgaggctcccaaccctcggaaggcctcggtcgatcaggcatttctggcccaagttcgagctactctcgtgcagcgaaacgacgtccgtgttgccaacgctcagaatctcaaggagcaggaacccctgaagtccgatgccgaccacgtcgagaagctctctgaagccgagtctgtctaagcggccgcttaattaata

SEQ ID NO: 213 - DNA, 925 bp, artificial sequence
  expression cassette for futC
aattaattatccatggccttcaaggtcgtgcagatctgcggtggactgggcaaccagatgtttcaatacgctttcgccaagtccctgcagaagcacctcaacactcccgttctgctcgacattacctccttcgactggtcgaaccgaaagatgcagctggagctgtttcccatcgaccttccttacgcctctgcgaaggagattgctatcgccaaaatgcagcaccttcccaagctggtccgagacaccctcaagtgtatgggcttcgaccgggtttcgcaggagatcgtgttcgaatacgagcctggactgctcaagccctcccgacttacctacttctatggctactttcaggatccgcgatacttcgacgccatttctcccctcatcaagcagacgttcactcttcctccacccgagaatggaaacaacaagaaaaaggaggaagaataccacagaaagctggctctcatccttgccgcaaagaactccgtgttcgtccatgtgcgacgtggcgactacgtcggtattggatgtcaactgggcatcgactaccagaagaaagccctcgagtacattgcgaagcgagttcccaacatggagctgtttgtgttctgcgaggatctcaagttcacccagaacttggacctgggttaccccttcatggatatgactacccgagacaaggaggaagaggcctactgggacatgctgctcatgcagtcctgcaagcatggcatcattgccaacagcacctactcctggtgggctgcctacctcatcaacaatcccgagaagatcattatcggacccaagcattggctgtttggtcacgagaacatcctctgcaaggagtgggtcaagatcgaatcgcacttcgaggtcaagtccaaaaagtacaacgcttagcggccgcttaattata

SEQ ID NO: 214 - DNA, 10614 bp, artificial sequence
  Plasmid pYKH033
aaacagtgtacgcagtactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggcctgcctcatccccgagaacctgcgaaaccccaagaaagtccacgagaaccgacttcctaccagagcctactattacgaccaggatatcttcgagtctctcaacggaccctgggcttttgccctgttcgacgcacctctcgatgctcccgacgccaagaacctggactgggaaactgccaagaaatggtccaccatttctgttccatcgcactgggagctgcaggaggactggaagtacggcaagcccatctacaccaacgtgcagtatcccattcctatcgacattcccaatccacccactgtcaaccctacaggcgtgtacgcccgaaccttcgagctcgattccaagtctatcgaatcgttcgagcatcggctgcgattcgagggagtcgacaactgttacgagctctatgtcaacggtcagtacgttggcttcaacaagggttcccgaaacggagccgagttcgacattcagaagtacgtctccgaaggcgagaacctggttgtggtcaaggtgttcaagtggagcgactccacctacatcgaggatcaagaccagtggtggctcagcggcatctaccgagacgtctctcttctcaagctgcccaaaaaggctcacatcgaggacgtccgtgttaccactacctttgtcgattcgcagtaccaagacgccgagctgtccgtcaaggtggatgttcagggatctagctacgaccacatcaactttaccctctacgaacccgaggacggttccaaggtctacgatgcgtcttcgcttctcaacgaagagaatggcaacactacgttttccaccaaggagttcatttcgttttccaccaagaaaaacgaggaaactgccttcaagatcaacgtcaaggctcccgagcactggacagccgagaatccgaccctgtacaagtatcagctcgatctcatcggttccgacggatcggtcattcagtctatcaagcatcacgtgggctttcgacaagtcgagctcaaggacggaaacatcaccgtcaacggcaaggacattctctttcgtggagtcaaccgacacgatcatcaccctcgattcggtcgtgccgttcccctggactttgtcgttcgggatctcattctcatgaaaaagttcaacatcaatgcggttcgaaactcccactatcccaaccatccaaaggtgtacgatctcttcgacaagctgggcttttgggtcatcgacgaagccgatctcgagactcacggtgttcaggagcccttcaaccgacataccaatctggaagccgagtaccccgacacgaagaacaaactctacgacgtcaacgctcactacttgtccgacaacccggagtacgaagttgcctatctggatcgagcatcgcagctcgtgcttcgggacgtcaatcacccctccatcattatctggtctctcggcaacgaggcctgttacggacgaaaccacaaggctatgtacaagcttatcaagcagctggatcccaccagacttgtccactacgagggcgacctcaacgcactgtctgccgacatcttctccttcatgtaccctactttcgagatcatggaacgatggcggaagaaccataccgacgagaacggcaagttcgagaagcccctcattctttgcgagtacggtcacgctatgggtaacggacctggctccctcaaggagtatcaggaactgttctacaaggagaaattctaccagggtggcttcatctgggagtgggccaaccacggtatcgagttcgaagatgtcagcacagccgatggcaagctgcacaaggcttacgcctacggtggagacttcaaggaggaagtgcatgatggcgtcttcatcatggacggactgtgcaactccgagcacaatccgactcccggactcgtggagtacaagaaagtcatcgaacccgttcacatcaagattgctcatggctcggtgaccatcaccaataagcacgacttcattacaaccgatcatctcctgttcatcgacaaggataccggcaagactatcgacgttccctctctcaagcccgaggaatccgtcaccattccttcggacactacctacgtcgtggccgttctcaaggacgatgctggagtcctcaaggccggtcacgagattgcatggggacaggccgagctgcctctcaaggttcccgacttcgtcaccgagacagccgagaaagctgcgaagatcaacgatggcaagcgatacgtttccgtcgagtcttcgggtcttcacttcattctggacaaactcttgggcaagatcgagtccctcaaggtcaaaggcaaggagatctcgagcaagttcgaaggttcctcgattaccttttggcgacctcccacgaacaatgacgagcctcgagacttcaagaactggaaaaagtacaacatcgaccttatgaagcagaacattcacggcgtgtccgtcgagaagggatcgaacggctctctggctgtcgtcaccgtcaactccagaatctctcccgtggtcttttactatggtttcgaaactgtgcagaagtacaccattttcgccaacaagatcaatctcaacacctccatgaagcttactggcgagtaccaacctcccgactttccacgagtcggatacgagttttggcttggcgattcctacgaatcgttcgagtggctcggacgtggtcctggcgagtcttaccccgacaagaaagaatcccagcgattcggactgtacgacagcaaggatgtcgaagagtttgtgtacgactatcctcaggagaacggcaatcacaccgacacccactttctcaacatcaagttcgagggtgcaggcaagctctccatctttcagaaggagaaacccttcaacttcaagatttcggacgagtacggcgtggacgaagcagctcatgcctgcgacgtcaagcgatacggacggcactacttgcgactggatcatgccattcacggtgtcggctccgaggcttgcggtcccgcagtgctggaccagtaccgactcaaggcccaggacttcaactttgagttcgacctggccttcgagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgtcgacgttt

SEQ ID NO: 215 - DNA, 8536 bp, artificial sequence
  Plasmid pYKH036
gtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatagttggagcaagggagaaatgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgggtcatcaccatcatcatcacgggtccctgcaggactcagaagtcaatcaagaagctaagccagaggtcaagccagaagtcaagcctgagactcacatcaatttaaaggtgtccgatggatcttcagagatcttcttcaagatcaaaaagaccactcctttaagaaggctgatggaagcgttcgctaaaagacagggtaaggaaatggactccttaacgttcttgtacgacggtattgaaattcaagctgatcagacccctgaagatttggacatggaggataacgatattattgaggctcaccgcgaacagattggaggtgccttcaaggtcgtgcagatctgcggtggactgggcaaccagatgtttcaatacgctttcgccaagtccctgcagaagcacctcaacactcccgttctgctcgacattacctccttcgactggtcgaaccgaaagatgcagctggagctgtttcccatcgaccttccttacgcctctgcgaaggagattgctatcgccaaaatgcagcaccttcccaagctggtccgagacaccctcaagtgtatgggcttcgaccgggtttcgcaggagatcgtgttcgaatacgagcctggactgctcaagccctcccgacttacctacttctatggctactttcaggatccgcgatacttcgacgccatttctcccctcatcaagcagacgttcactcttcctccacccgagaatggaaacaacaagaaaaaggaggaagaataccacagaaagctggctctcatccttgccgcaaagaactccgtgttcgtccatgtgcgacgtggcgactacgtcggtattggatgtcaactgggcatcgactaccagaagaaagccctcgagtacattgcgaagcgagttcccaacatggagctgtttgtgttctgcgaggatctcaagttcacccagaacttggacctgggttaccccttcatggatatgactacccgagacaaggaggaagaggcctactgggacatgctgctcatgcagtcctgcaagcatggcatcattgccaacagcacctactcctggtgggctgcctacctcatcaacaatcccgagaagatcattatcggacccaagcattggctgtttggtcacgagaacatcctctgcaaggagtgggtcaagatcgaatcgcacttcgaggtcaagtccaaaaagtacaacgcttagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 216 - DNA, 23 bp, artificial sequence
  primer
tacgattccgccaagtgagactg

SEQ ID NO: 217 - DNA, 23 bp, artificial sequence
  primer
ccaagcattggctgtttggtcac

SEQ ID NO: 218 - DNA, 23 bp, artificial sequence
  primer
caaggcactgagctcgtctaacg

SEQ ID NO: 219 - DNA, 23 bp, artificial sequence
  primer
catagcaactctgtctgggcgag

SEQ ID NO: 220 - DNA, 24 bp, artificial sequence
  primer
ctacggctattctcattccaagcg

SEQ ID NO: 221 - DNA, 20 bp, artificial sequence
  primer
cggtgcctgccatgatgaag

SEQ ID NO: 222 - DNA, 26 bp, artificial sequence
  primer
ccaagatgtatgcgtactggattacc

SEQ ID NO: 223 - DNA, 21 bp, artificial sequence
  primer
cttgcccaggtgaatggaagc

SEQ ID NO: 224 - DNA, 22 bp, artificial sequence
  primer
gtagcacaaggcacctagctcg

SEQ ID NO: 225 - DNA, 26 bp, artificial sequence
  primer
gttgacatgaatgaagttaccgttgg

SEQ ID NO: 226 - DNA, 22 bp, artificial sequence
  primer
accttgcttctcctgcacttgc

SEQ ID NO: 227 - DNA, 27 bp, artificial sequence
  primer
tgcttgtatcgtacattctcaagtgtc

SEQ ID NO: 228 - DNA, 25 bp, artificial sequence
  primer
ttcctctctcaccactaccaagtcc

SEQ ID NO: 229 - DNA, 28 bp, artificial sequence
  primer
gttcttatgaacggagtctactctatcg

SEQ ID NO: 230 - DNA, 24 bp, artificial sequence
  primer
gtcttctcgtatcgggctgtacag

SEQ ID NO: 231 - DNA, 22 bp, artificial sequence
  primer
gtatgtggaaaaggcagccacg

SEQ ID NO: 232 - DNA, 24 bp, artificial sequence
  primer
catcatcataccaagtgaacacgg

SEQ ID NO: 233 - DNA, 22 bp, artificial sequence
  primer
tgttgccaacgctcagaatctc

SEQ ID NO: 234 - DNA, 24 bp, artificial sequence
  primer
ccaccactgcactaccactacacc

SEQ ID NO: 235 - DNA, 26 bp, artificial sequence
  primer
agcacagcagtcagcatgtatgttag

SEQ ID NO: 236 - DNA, 58 bp, artificial sequence
  primer
cgatattattgaggctcaccgcgaacagattggaggtgccttcaaggtcgtgcagatc

SEQ ID NO: 237 - DNA, 20 bp, artificial sequence
  primer
aattaagcggccgctaagcg

SEQ ID NO: 238 - DNA, 24 bp, artificial sequence
  primer
tacaatccatgggtcatcaccatc

SEQ ID NO: 239 - DNA, 19 bp, artificial sequence
  primer
acctccaatctgttcgcgg

SEQ ID NO: 240 - DNA, 21 bp, artificial sequence
  primer
ttccgagccgtgagtatccac

SEQ ID NO: 241 - DNA, 24 bp, artificial sequence
  primer
atatccgttgctatatcctcgcac

SEQ ID NO: 242 - DNA, 20 bp, artificial sequence
  primer
ttggccactggatctccaag

SEQ ID NO: 243 - DNA, 20 bp, artificial sequence
  primer
gcacagtggtgcagtacttg

SEQ ID NO: 244 - DNA, 20 bp, Artificial Sequence
  primer
acctgagtcacaatcttcgg

SEQ ID NO: 245 - DNA, 20 bp, artificial sequence
  primer
catttcattagcagggctgg

SEQ ID NO: 246 - DNA, 24 bp, artificial sequence
  primer
agagtcagcctttgcgcagatgtc

SEQ ID NO: 247 - DNA, 1122 bp, Arabidopsis thaliana
atggcttctgaaaacaatggttctagatccgactctgaatctatcaccgctccaaaggctgattccaccgttgtcgaaccaagaaagatcgctttgatcactggtattactggtcaagatggttcatacttgactgagttcttgttaggcaagggttacgaagttcacggtttgatcagacgttctagcaacttcaacacccaaagaatcaatcacatctacattgatccacacaacgttaacaaggctttgatgaagttgcactacgccgacttaaccgacgcttcttccttgagacgttggattgatgttatcaaaccagacgaagtttacaacttggctgcccaatctcacgttgctgtttctttcgaaattccagactacactgctgacgttgtcgctacaggcgctttgagattgctagaagccgtcagatcccacactattgattctggtagaactgtcaagtactaccaagccggttcttccgaaatgttcggttctaccccacctccccaatctgaaaccactcctttccacccaagatccccatacgctgcctctaagtgtgctgcccactggtacactgtcaactacagagaagcctacggtttgtttgcttgtaacggtatcttgttcaaccatgaatccccaagacgtggtgaaaacttcgttaccagaaagataaccagagctttaggtagaatcaaggttggtttgcaaactaagttattcttgggtaacttgcaagctagtagagactggggtttcgctggtgactacgtggaagctatgtggttgatgttgcaacaagaaaagccagacgattacgttgtagctaccgaagagggtcacaccgttgaagagttcctagacgtctctttcggttacttgggtttgaactggaaggactacgtcgaaatcgaccaaagatactttagaccagctgaagttgacaacttacaaggtgacgcttccaaagccaaggaagtcttgggttggaagccacaagtcggtttcgaaaagttggttaagatgatggtcgatgaagacttggaactagctaagagagaaaaggtcctagtcgatgctggttacatggacgccaagcaacaaccatag

SEQ ID NO: 248 - DNA, 972 bp, Arabidopsis thaliana
atggctgaaaccatcggttctgaagttagctctatgtccgacaagtccgccaagatattcgtcgctggtcacagaggtttggtcggttccgctattgtcagaaagttgcaagaacaaggtttcaccaacctagttttgaagacccacgctgaactagacttgactagacaagctgacgttgaatctttcttttcccaagaaaagccagtctacgtcatcttggctgccgctaaggtcggtggcatccacgccaacaatacctacccagctgatttcattggtgttaacttgcaaatccaaacaaacgttattcactccgcttacgaacacggtgtcaagaaattgctattcttgggttcttcctgtatctacccaaagttcgctccacaacctatcccagaatctgctttgttaaccgcttctttggaacctaccaacgaatggtacgctatcgctaagattgccggtatcaagacttgtcaagcctacagaatccaacacggttgggatgctatctctggtatgccaaccaatttgtacggtccaaacgacaacttccacccagaaaacagtcacgttttgccagccctaatgagacgtttccatgaagccaaggtcaacggtgctgaagaggttgtcgtgtggggtactggttctcccttgagagagttcttgcacgttgacgatttggctgacgcctgtgtcttcttgttagatagatactcaggtttggaacacgtcaacatcggctctggtcaagaagttactattagagaattagctgaattggttaaggaagttgtcggtttcgaaggtaagttgggttgggactgtaccaagccagatggtactccacgtaagttgatggactcttccaaattggcttccttaggttggactccaaaggtttctttgagagacggtttgtctcaaacttacgactggtacttaaagaacgtttgcaacagatag

SEQ ID NO: 249 - DNA, 60 bp, Articifial Sequence
ataaccataaccaagtaatacatattcaaatggctgaaaccatcggttctgaagttagct

SEQ ID NO: 250 - DNA, 60 bp, Artificial Sequence
  Primer
atgcaagatttaaagtaaattcacggccctgcaggctatctgttgcaaacgttctttaag

SEQ ID NO: 251 - DNA, 60 bp, Artificial Sequence
  Primer
cgcaaaataacacagtcaaatcaatcaaaatggcttctgaaaacaatggttctagatccg

SEQ ID NO: 252 - DNA, 60 bp, Artificial Sequence
  Primer
atcataaatcataagaaattcgcttactcctatggttgttgcttggcgtccatgtaacca

SEQ ID NO: 253 - DNA, 45 bp, Artificial Sequence
  Primer
aattcggtcgaaaaaagaaaaggaggcagattgtactgagagtgc

SEQ ID NO: 254 - DNA, 45 bp, Artificial sequence
  Primer
caggcaagtgcacaaacaatacttagtgcggtatttcacaccgca

SEQ ID NO: 255 - DNA, 20 bp, Artificial sequence
  Primer
gccagaggtcaagccagaag

SEQ ID NO: 256 - DNA, 20 bp, Artificial Sequence
  Primer
ccgttgtcgtcgttcttcaa

SEQ ID NO: 257 - DNA, 31 bp, Artificial Sequence
  Primer
tatgtttaaacccatcatttggggtcagcac

SEQ ID NO: 258 - DNA, 32 bp, Artificial Sequence
  Primer
ttaccatggtgtattagcgagtggataaagtg

SEQ ID NO: 259 - DNA, 32 bp, Artificial Sequence
  Primer
aataatgaattcccatcatttggggtcagcac

SEQ ID NO: 260 - DNA, 41 bp, Artificial Sequence
  Primer
gtatatttaattaacgtacgcaactaacatgaatgaatacg

What is claimed is:

1. A genetically engineered yeast cell, wherein:
   the cell comprises:
   a) at least one heterologous nucleic acid molecule encoding a transporter protein that facilitates export of 2' fucosyllactose from the yeast cell, wherein the transporter protein is selected from the group consisting of
      a Sugars Will Eventually be Exported Transporter (SWEET) family transporter having at least 90% identity to a peptide selected from the group consisting of SEQ ID NO: 93, 94, 95, and 96,
      a Sugar Efflux Transporter A (SetA) family transporter having at least 90% identity to a peptide selected from the group consisting of SEQ ID NO: 88, 105, 106, 107, and 108, and
      a sugar porter family transporter having at least 90% identity to a peptide selected from the group consisting of SEQ ID NO: 65 and SEQ ID NO: 66;
   b) at least one heterologous nucleic acid molecule encoding a guanosine diphosphate (GDP)-mannose-4,6-dehydratase (EC 4.2.1.47);
   c) at least one heterologous nucleic acid molecule encoding a GDP-4-keto-6-D-deoxymannose epimerase-reductase (EC 1.1.1.271); and
   d) at least one heterologous nucleic acid molecule encoding a 2-α-L-fucosyltransferase (EC 2.4.1.69); and
   said yeast cell produces 2' fucosyllactose.

2. The genetically engineered yeast cell of claim 1 wherein the yeast is selected from the group of genera consisting of *Saccharomyces, Yarrowia, Kluyveromyces, Candida, Hansenula, Pichia, Schizosaccharomyces, Zygosaccharomyces, Debaryomyces, Brettanomyces, Pachysolen, Issatchenkia, Trichosporon*, and *Yamadazyma*.

3. The genetically engineered yeast cell of claim 1, wherein the at least one heterologous nucleic acid molecule of any of parts b) c) or d) is derived from a bacteria or a fungus.

4. The genetically engineered yeast cell of claim 1, wherein the heterologous nucleic acid molecule of part a) further comprises a polynucleotide that encodes a peptide that facilitates localization of the transporter protein to a plasma membrane of the cell.

5. The genetically engineered yeast cell of claim 1, wherein the cell further comprises at least one polynucleotide encoding a lactose transporter.

6. The genetically engineered yeast cell of claim 5, wherein the lactose transporter is a lactose permease.

7. A genetically engineered yeast cell that produces 2' fucosyllactose, wherein the yeast cell comprises:
   a) at least one heterologous nucleic acid molecule encoding a transporter protein that facilitates export of 2' fucosyllactose from the yeast cell;
   b) at least one heterologous nucleic acid molecule encoding a guanosine diphosphate (GDP)-mannose-4,6-dehydratase (EC 4.2.1.47);
   c) at least one heterologous nucleic acid molecule encoding a GDP-4-keto-6-D-deoxymannose epimerase-reductase (EC 1.1.1.271);
   d) at least one heterologous nucleic acid molecule encoding a 2-α-L-fucosyltransferase (EC 2.4.1.69); and
   e) at least one nucleic acid molecule encoding a lactose transporter having an amino acid sequence having 90% identity to peptide selected from the group consisting of SEQ ID NO: 24, 25, 26, 27 and 28.

8. A yeast cell, which is genetically engineered, the yeast cell comprising:
   a) at least one heterologous polynucleotide encoding a transporter protein that facilitates export of 2' fucosyllactose from the yeast cell, wherein the transporter protein is selected from the group consisting of a Sugars Will Eventually be Exported Transporter (SWEET) family transporter having at least 90% identity to a peptide selected from the group consisting of SEQ ID NO: 93, 94, 95, and 96, a Sugar Efflux Transporter A (SetA) family transporter having at least 90% identity to a peptide selected from the group consisting of SEQ ID NO: 88, 105, 106, 107, and 108, and a Sugar porter family transporter having at least 90% identity to a peptide selected from SEQ ID NO: 65 and SEQ ID NO: 66;
b) at least one heterologous polynucleotide encoding a guanosine diphosphate (GDP)-mannose-4,6-dehydratase (EC 4.2.1.47);
c) at least one heterologous polynucleotide encoding a GDP-4-keto-6-D-deoxymannose epimerase-reductase (EC 1.1.1.271); and
d) at least one heterologous polynucleotide encoding a 2-α-L-fucosyltransferase (EC 2.4.1.69);
wherein the yeast cell produces 2' fucosyllactose.

9. The yeast cell of claim 8, wherein the yeast cell is selected from the group of genera consisting of *Saccharomyces, Yarrowia, Kluyveromyces, Candida, Hansenula, Pichia, Schizosaccharomyces, Zygosaccharomyces, Debaryomyces, Brettanomyces, Pachysolen, Issatchenkia, Trichosporon*, and *Yamadazyma*.

10. The yeast cell of claim 8, wherein the at least one heterologous polynucleotide of any of parts b), c), or d) are derived from a bacteria or a fungus.

11. The yeast cell of claim 8, wherein the heterologous polynucleotide of part a) further comprises a polynucleotide encoding a peptide that facilitates localization of the transporter protein to a plasma membrane of the yeast cell.

12. A yeast cell comprising:
a) at least one heterologous polynucleotide encoding a transporter protein that facilitates export of 2' fucosyllactose from the yeast cell, wherein the transporter protein is selected from the group consisting of a Sugars Will Eventually be Exported Transporter (SWEET) family transporter, a Sugar Efflux Transporter A (SetA) family transporter, and a sugar porter family transporter;
b) at least one heterologous polynucleotide encoding a guanosine diphosphate (GDP)-mannose-4,6-dehydratase (EC 4.2.1.47);
c) at least one heterologous polynucleotide encoding a GDP-4-keto-6-D-deoxymannose epimerase-reductase (EC 1.1.1.271);
d) at least one heterologous polynucleotide encoding a 2-α-L-fucosyltransferase (EC 2.4.1.69);
wherein the yeast cell produces 2' fucosyllactose, and
e) at least one polynucleotide encoding a lactose transporter having at least 90% identity to a peptide selected from the group consisting of SEQ ID NO: 24, 25, 26, 27, and 28.

13. The yeast cell of claim 12, wherein the lactose transporter is a lactose permease.

14. A method of using the yeast cell of claim 7 to produce 2' fucosyllactose, the method comprising:
growing the yeast cell under suitable conditions and in suitable media so as to produce 2' fucosyllactose and export 2' fucosyllactose to the media.

15. A method of using the yeast cell of claim 8 to produce 2' fucosyllactose, the method comprising:
growing the yeast cell under suitable conditions and in suitable media so as to produce 2' fucosyllactose and export 2' fucosyllactose to the media.

16. A method of using the yeast cell of claim 12 to produce 2' fucosyllactose, the method comprising:
growing the yeast cell under suitable conditions and in suitable media so as to produce 2' fucosyllactose and export 2' fucosyllactose to the media.

17. A method of using the yeast cell of claim 1 to produce 2' fucosyllactose, the method comprising:
growing the yeast cell under suitable conditions and in suitable media so as to produce 2' fucosyllactose and export 2' fucosyllactose to the media.

* * * * *